United States Patent
Barney et al.

(10) Patent No.: US 6,562,787 B1
(45) Date of Patent: *May 13, 2003

(54) HYBRID POLYPEPTIDES WITH ENHANCED PHARMACOKINETIC PROPERTIES

(75) Inventors: Shawn Barney, Apex, NC (US); Kelly I. Guthrie, Graham, NC (US); Gene Merutka, Hillsborough, NC (US); Mohmed K. Anwer, Foster City, CA (US); Dennis M. Lambert, Cary, NC (US)

(73) Assignee: Trimeris, Inc., Durham, NC (US)

( * ) Notice: Subject to any disclaimer, the term of this patent is extended or adjusted under 35 U.S.C. 154(b) by 111 days.

This patent is subject to a terminal disclaimer.

(21) Appl. No.: 09/834,784

(22) Filed: Apr. 13, 2001

Related U.S. Application Data

(63) Continuation of application No. 09/082,279, filed on May 20, 1998, now Pat. No. 6,258,782.

(51) Int. Cl.⁷ .............................................. A61K 38/16
(52) U.S. Cl. ............................................ 514/12; 514/2
(58) Field of Search ................................ 514/2, 12, 13, 514/15; 530/300, 313, 324, 326, 350, 397, 398, 399

(56) References Cited

U.S. PATENT DOCUMENTS

| | | | |
|---|---|---|---|
| 5,122,614 A | 6/1992 | Zalipsky ..................... | 548/520 |
| 5,357,041 A | 10/1994 | Roberts et al. ............. | 530/326 |
| 5,358,934 A | 10/1994 | Borovsky et al. ............ | 514/17 |
| 5,464,933 A | 11/1995 | Bolognesi et al. ........... | 530/32 |
| 5,656,480 A | 8/1997 | Wild et al. ................... | 435/325 |
| 5,723,129 A | 3/1998 | Potter et al. ............. | 424/200.1 |
| 5,763,160 A | 6/1998 | Wang ............................ | 435/5 |
| 5,843,913 A | 12/1998 | Li et al. ....................... | 514/44 |
| 5,932,462 A | 8/1999 | Harris et al. ................ | 435/188 |
| 5,968,776 A | 10/1999 | Klein et al. .................. | 435/693 |
| 6,080,724 A | 6/2000 | Chassaing et al. ............ | 514/13 |
| 6,258,782 B1 * | 7/2001 | Barney et al. ................ | 514/13 |
| 6,348,568 B1 * | 2/2002 | Barney et al. .............. | 530/300 |

FOREIGN PATENT DOCUMENTS

| | | |
|---|---|---|
| EP | 272858 | 6/1988 |
| EP | 306912 | 3/1989 |
| EP | 578293 | 1/1994 |
| WO | WO 91/07664 | 5/1991 |
| WO | WO 91/09872 | 7/1991 |
| WO | WO 93/14207 | 7/1993 |
| WO | WO 96/19495 | 6/1996 |
| WO | WO 99/59615 | 11/1999 |

OTHER PUBLICATIONS

Adams et al., 1985, "The c-myc oncogene driven by immunoglobulin enhancers induces lymphoid malignancy in transgenic mice", Nature 318:533–538.

(List continued on next page.)

Primary Examiner—Jeffrey E. Russel
(74) Attorney, Agent, or Firm—Pennie & Edmonds LLP

(57) ABSTRACT

The present invention relates to enhancer peptide sequences originally derived from various retroviral envelope (gp41) protein sequences that enhance the pharmacokinetic properties of any core polypeptide to which they are linked. The invention is based on the discovery that hybrid polypeptides comprising the enhancer peptide sequences linked to a core polypeptide possess enhanced pharmacokinetic properties such as increased half life. The invention further relates to methods for enhancing the pharmacokinetic properties of any core polypeptide through linkage of the enhancer peptide sequences to the core polypeptide. The core polypeptides to be used in the practice of the invention can include any pharmacologically useful peptide that can be used, for example, as a therapeutic or prophylactic reagent.

54 Claims, 21 Drawing Sheets

OTHER PUBLICATIONS

Figure 3:
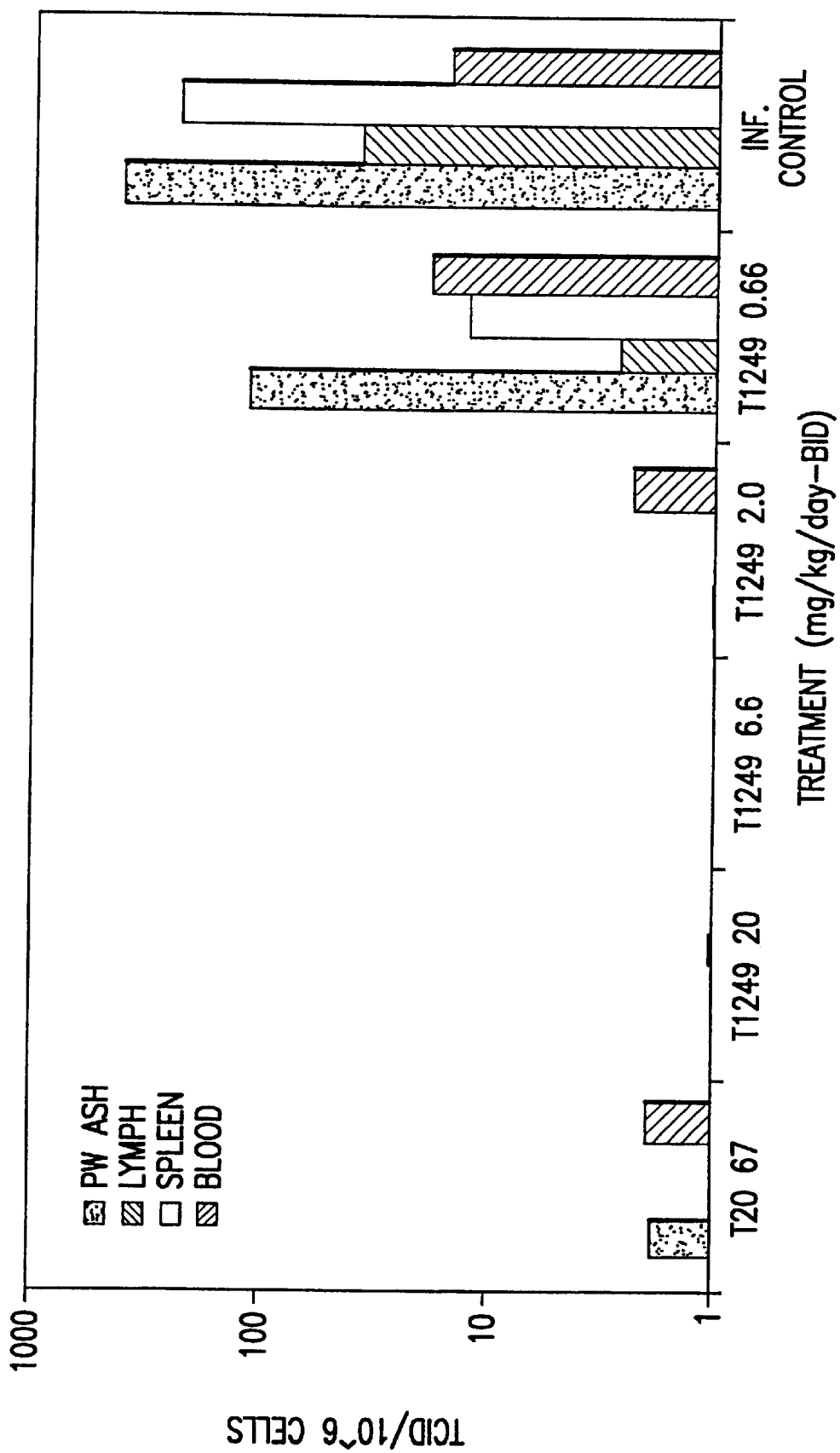

Alexander et al., 1987, "Expression of the c–myc oncogene under control of an immunoglobulin enhancer in Eμ–myc transgenic mice", Mol. Cell. Biol. 5:1436–1444.

Fingl & Woodbury, 1975, in "The Pharmacological Basis of Therapeutics", Ch.1 p. 1.

Goff et al., 1981, "Isolation properties of Moloney Murine Leukemia virus mutants: use of rapid assay for release of virion reverse transcriptase", J. Virol. 62:139–147.

Grosschedl et al., 1984, "Introduction of a μ immunoglobulin gene into the mouse germline: specific expression in lymphoid cells and synthesis of functional antibody", Cell 38:647–658.

Hammer et al., 1987, "Diversity of Alpha–protein gene expression in mice is generated by a combination of separate enhancer elements", Science 235:53–58.

Hanahan, 1985, "Heritable formation of pancreatic β–Cell tumors in transgenic mice expressing recombinant insulin/simian virus 40 oncogenes", Nature 315:115–122.

Kollias et al., 1986, "Regulated expression of Human $^A\gamma$–, β–, and hybrid γβglobin genes in transgenic mice: manipulation of the developmental expression patterns", Cell 46:89–94.

Krumlauf et al., 1985, "Developmental regulation of α–fetoprotein genes in transgenic mice", Mol. Cell. Biol. 5:1639–1648.

Macdonald, 1987, "Expression of the pancreatic elastase I genes in transgenic mice", Hepatology 7:42S–51S.

Magram et al.,1985, "Developmental regulation of a clothed adult β–globulin gene in transgenic mice", Nature 315:338–340.

Mason et al., 1986, "The hypogonadal mouse: reproductive functions restored by gene therapy", Science 234:1372–1378.

Matthews et al., 1987, "Interaction between the human T–cell lymphotropic virus type IIIB envelope glycoprotein gp120 and the surface antigen CD4:role of carbohydrate in binding and cell fusion", PNAS 84:5424–5428.

Olson et al., 1993, "Concepts and progress in the development of mimetics", J. Me. Chem. 36:3049.

Ornitz et al., 1986, "Elastase I promoter directs expression of human growth hormone and SV40 T antigen genes to pancreatic acinar cells in transgenic mice", Cold Spring Harbor Symp. Quant. Biol. 50:399–409.

Pinkert al., 1987, "An albumin enhancer located 10Kb upstream functions along with it promoter to direct efficient, liver–specific expression in transgenic mice", Genes and Dev. 1:268–276.

Popovic et al., 1984, "Detection, Isolation, and continuous production of cytopathic retrovirus (HTVL–III) from patients with AIDS and Pre–AIDS", Science 224:497–508.

Readhead et al., 1987, "Expression of a myelin basic protein gene in transgenic shiverer mice: correction of the dysmyelinating phenotype", Cell 48:703–712.

Rimsky & Matthews, 1998, "Determinants of human Immunodeficiency virus type 1 resistance to gp41–derived inhibitory peptides", J. Virol. 72:986–993.

Shani M., 1985, "Tissue–specific expression of rat myosin light chain 2 gene in transgenic mice", Nature, 314:283–286.

Sigma Chemical Company, Biochemicals Organic Compounds For Research And Diagnostic Reagents, 1994, p. 1864.

Swift et al., 1984, "Tissue–specific expression of the rat pancreatic elastase I gene in transgenic mice", Cell 38:639–646.

Weislow et al., 1989, "New Soluble–formazan assay for HIV–1 cytopathic effects: application to high–flux screening of synthetic and natural products for AIDS–antiviral activity", J. Natl. Cancer Inst. 81:577–586.

Willey, 1988, "In vitro mutagenesis identifies a region within the envelope gene of the human immunodeficiency virus that is critical for infectivity", J. Virol. 62:139–147.

* cited by examiner

| PHARMACOKINETIC PARAMETERS | T20BQ1 | T1249A1 |
|---|---|---|
| DOSE (mg/kg IV) | 2.5 | 2.5 |
| DETECTION METHOD | FLUORESCENCE HPLC | FLUORESCENCE HPLC |
| $T_{1/2\beta}$ (h) | 1.6 | 4.71 |
| $Cl_\beta$ (ml/h) | 27.94 | 9.62 |
| $AUC_{[0-8]}$ (ug/h/ml) | 26.12 | 71.43 |

| Trimeris No. | | Sequence | | IP t1/2 | Peptide | HIV-1 Fusion EC-50 ng/ml | RSV Fusion EC-50 ng/ml |
|---|---|---|---|---|---|---|---|
| | | NNMTWMEWDREINNYTSLIHSLIEESQNQQEKNEQELLELDKWASLWNWF | | | | | |
| HIV-1 T20 | Ac- | YTSLIHSLIEESQNQQEKNEQELLELDKWASLWNWF | -NH2 | 1.5h | HIV-1 T20 | 3 | >20000 |
| HIV-1 T379 | Ac- | YTSLIHSLIEESQNQQEKNEQELLELDKWASLFNF | -NH2 | 20m | HIV-1 T379 | 3 | |
| SIV T402 | Ac- | LEENITALLEEAQIQQEKNMYELQKLNSWDVFGNWF | -NH2 | 20m | SIV T402 | 3 | |
| HIV-2 T698 | Ac- | LEANISQSLEQAQIQQEKNMYELQKLNSWDVFTNWL | -NH2 | <20m | HIV-2 T698 | 50 | |
| HIV-1 T649 | Ac- | WMEWDREINNYTSLIHSLIEESQNQQEKNEQELLEL | -NH2 | 20m | HIV-1 T649 | 7 | |
| SIV T391 | Ac- | WQEWERKVDFLEENITALLEEAQIQQEKNMYELQKL | -NH2 | 20m | SIV T391 | 15 | |
| HIV-2 T856 | Ac- | WQEWEQKVRYLEANISQSLEQAQIQQEKNMYELQKL | -NH2 | 20m | HIV-2 T856 | 7 | |
| HYBRID T1052 | Ac- | WQEWEQKVRYLEANITALLEQAQIQQEKNEYELQKL | -NH2 | 20m | HYBRID T1052 | 9 | |
| | | | | IV t1/2 | | | |
| HIV-1 T625 | Ac- | NNYTSLIHSLIEESQNQQEKNEQELLELDKWASLWNWF | -NH2 | >4h | HIV-1 T625 | 7 | |
| HIV-1 T866 | Ac- | DREINNYTSLIHSLIEESQNQQEKNEQELLELDKWASLWNWF | -NH2 | >4h | HIV-1 T866 | 5 | |
| HIV-1 T867 | Ac- | MTWMEWDREINNYTSLIHSLIEESQNQQEKNEQELLELDK | -NH2 | 20m | HIV-1 T867 | 6 | |
| | | NNMTWMEWDREINNYTSLIHSLIEESQNQQEKNEQELLELDK | | | | | |

FIG.13A

FIG. 13B

| HIV-1/SIV/HIV-2 HYBRIDS | N-term | N-terminal sequence | Hybrid (T1052-like) Core Sequence | C-terminal sequence | C-term | IV t1/2 | Hybrid | Value |
|---|---|---|---|---|---|---|---|---|
| HYBRID T1387 | Ac- | | TALLEQAQIQQEKNEYELQKLDK | | -NH2 | <5m | HYBRID T1387 | >10000 |
| HYBRID T1388 | Ac- | | TALLEQAQIQQEEKIIEYELQKL | | -NH2 | <5m | HYBRID T1388 | >10000 |
| HYBRID T1226 | Ac- | WQEWEQKVRYLEAN | TALLEQAQIQQEKNEYELQKLDK | WASLWNWF | -NH2 | | HYBRID T1226 | 4 |
| HYBRID T1227 | Ac- | NNMTWQEWEQKVRYLEAN | TALLEQAQIQQEKNEYELQKLDK | WASLWNWF | -NH2 | | HYBRID T1227 | 7 |
| HYBRID T1248 | Ac- | WNWF | | TALLEQAQIQQEKNEYELQKLDK | WASLWNWF | -NH2 | HYBRID T1248 | 6 |
| HYBRID T1267 | Ac- | WQEWDREI | SNYTSLI | TALLEQAQIQQEKNEYELQKLDE | WASLWNWF | -NH2 | HYBRID T1267 | 3 |
| HYBRID T1269 | Ac- | WQEWDREI | SNYTSLI | TALLEQAQIQQEKNEYELQKLIE | WEWF | -NH2 | HYBRID T1269 | 53 |
| HYBRID T1311 | Ac- | WQEWEREI | SAYTSLI | TALLEQAQIQQEKNEYELQKLIE | WEWF | -NH2 | HYBRID T1311 | 30 |
| HYBRID T1314 | Ac- | WQEWEREI | SAYTSLI | TALLEQAQIQQEKTEYELQKLIE | WEWF | -NH2 | HYBRID T1314 | 12 |
| HYBRID T1312 | Ac- | WQEWEREI | SAYTSLI | TALLEQAQIQQEKIEYELQKLE | WEWF | -NH2 | HYBRID T1312 | 5 |
| HYBRID T1313 | Ac- | WQEWEREI | | TALLEQAQIQQEKNEYELQKLE | WEWF | -NH2 | HYBRID T1313 | 6 |
| HYBRID T1275 | Ac- | WQEWDREI | | TALLEQAQIQQEKNEYELQKLDE | WASLWNWF | -NH2 | HYBRID T1275 | 7 |
| HYBRID T1226 | Ac- | WQEWDREI | | TALLEQAQIQQEKNEYELQKLDE | WASLWNWF | -NH2 | HYBRID T1226 | 3 |
| HYBRID T1277 | Ac- | WQEWEREI | | TALLEQAQIQQEKNEYELQKLIE | WEWF | 1h | HYBRID T1277 | 6 |
| HYBRID T1278 | Ac- | WQEWEREI | | TALLEQAQIQQEKIEYELQKLIE | WEWF | 2.5h | HYBRID T1278 | 3 |
| HYBRID T1279 | Ac- | WQEWEREI | | TALLEQAQIQQEKIEYELQKLDE | WASLWNWF | -NH2 | HYBRID T1279 | 7 |
| HYBRID T1280 | Ac- | WQEWEREI | | TALLEQAQIQQEKNEYELQKLDK | WASLWNWF | -NH2 | HYBRID T1280 | 1 |
| HYBRID T1247 | Ac- | WQEWEQKI | | TALLEQAQIQQEKNEYELQKLDK | WASLWNWF | 4.7h | HYBRID T1247 | 2 |
| HYBRID T1249 | Ac- | WQEWEQKI | | TALLEQAQIQQEKNEYELQKLDK | WASLWEWF | -NH2 | HYBRID T1249 | 2 |
| HYBRID T1353 | Ac- | WQEWEQKI | | TALLEQAQIQQEEKAEYELQKLAK | WASLWEWF | -NH2 | HYBRID T1353 | 28 3544 |
| HYBRID T1330 | Ac- | WQEWEQKI | | TALLEQAQIQQEEKAEYELQKLAK | WASLWEWF | -NH2 | HYBRID T1330 | 30 11136 |
| HYBRID T1331 | Ac- | WQEWEQKI | | TALLEQAQIQQEEKAEYELQKLAE | WASLWEWF | -NH2 | HYBRID T1331 | 18 |
| HYBRID T1332 | Ac- | WQEWEQKI | | TALLEQAQIQQEEKAEYELQKLAE | WASLWEWF | -NH2 | HYBRID T1332 | 33 |
| HYBRID T1333 | Ac- | WQEWEQKI | | TALLEQAQIQQEEKAEYELQKLAK | WASLWEWF | -NH2 | HYBRID T1333 | 35 |
| HYBRID T1334 | Ac- | WQEWEQKI | | TALLEQAQIQQEEKAEYELQKLAE | WAGLWEWF | -NH2 | HYBRID T1334 | 8 3819 |
| HYBRID T1347 | Ac- | WQEWEQKI | | TALLEQAQIQQEEKAEYELQKLAE | WASLWAWF | -NH2 | HYBRID T1347 | 6 4516 |
| HYBRID T1350 | Ac- | WQEWEQKI | | TALLEQAQIQQEEKAEYELQKLAE | WAGLWAWF | -NH2 | HYBRID T1350 | 7 5255 |
| HYBRID T1348 | Ac- | WQEWEQKI | | TALLEQAQIQQEEKAEYELQKLAE | WASLWAW | | HYBRID T1348 | |

| | | | | | | | IV t1/2 | | Biological Activity | | | |
|---|---|---|---|---|---|---|---|---|---|---|---|---|
| | | | | | | | | | RSV Fusion EC-50 ng/ml | | RSV Fusion EC-50 ng/ml | |
| HYBRID T1351 | Ac- | WQEWEQKI | TALLEQAQIQQEKNEYELQKLAEWAGLWAW | -NH2 | | | | | HYBRID T1351 | 8 | 20897 | |
| HYBRID T1349 | Ac- | WQEWEQKI | TALLEQAQIQQEKAEYELQKLAEWASLWAW | -NH2 | | | | | HYBRID T1349 | 86 | 15326 | |
| HYBRID T1352 | Ac- | WQEWEQKI | TALLEQAQIQQEKAEYELQKLAEWAGLWAW | -NH2 | | | | | HYBRID T1352

FIG. 13D

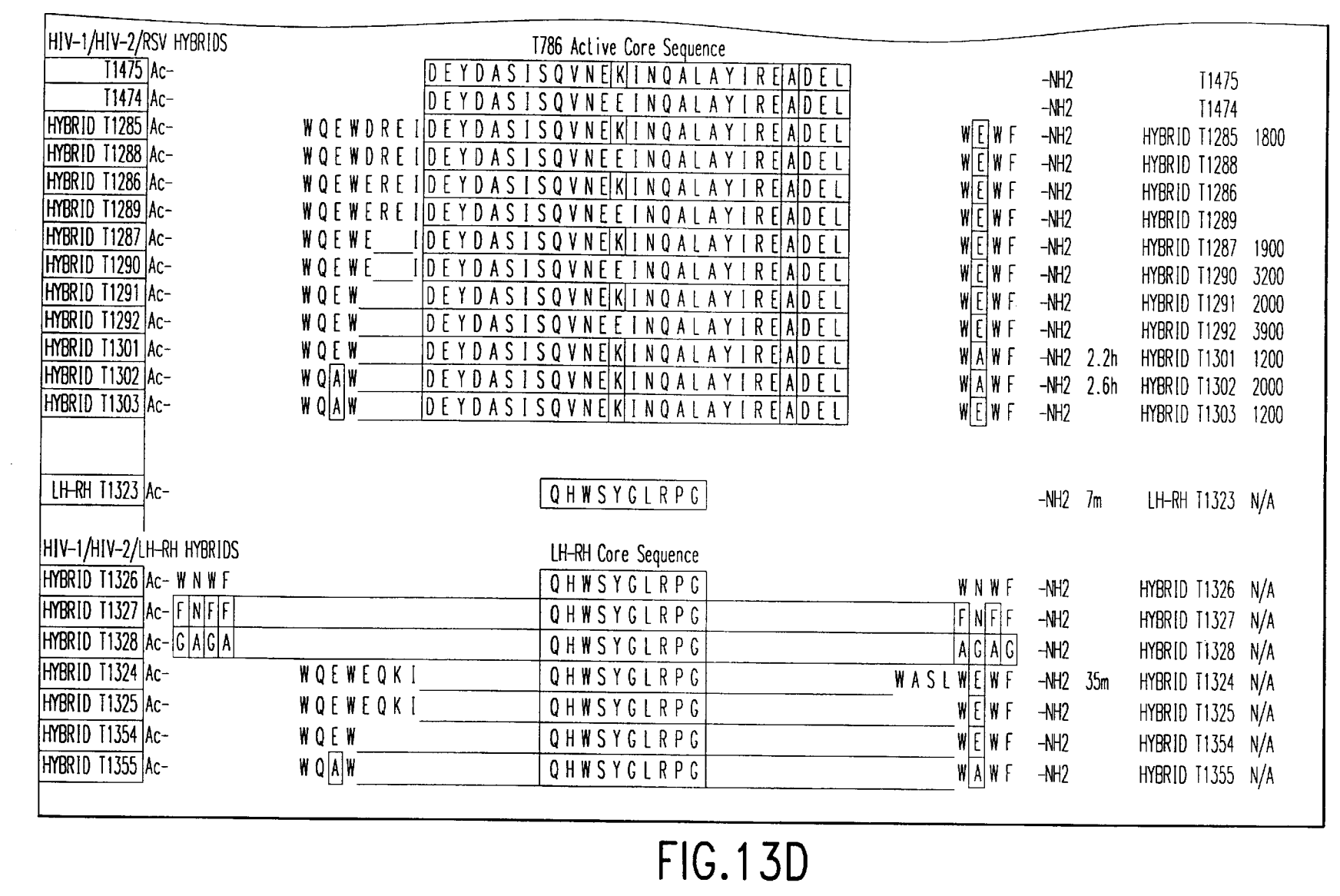

HIV-1/HIV-2/RSV HYBRIDS

| | | | T786 Active Core Sequence | | | |
|---|---|---|---|---|---|---|
| T1475 | Ac- | W Q E W D R E I | D E Y D A S I S Q V N E K I N Q A L A Y I R E A D E L | | | T1475 1800 |
| T1474 | Ac- | W Q E W D R E I | D E Y D A S I S Q V N E E I N Q A L A Y I R E A D E L | | | T1474 |
| HYBRID T1285 | Ac- | W Q E W E R E I | D E Y D A S I S Q V N E K I N Q A L A Y I R E A D E L | W E W F | -NH2 | H

HYBRID POLYPEPTIDES WITH ENHANCED PHARMACOKINETIC PROPERTIES This is a continuation of application Ser. No. 09/082,279 filed May 20, 1998, now U.S. Pat. No. 6,258,782 issued Jul. 10, 2001, the contents of which are incorporated herein by reference.

1. INTRODUCTION

The present invention relates to enhancer peptide sequences originally derived from various retroviral envelope (gp41) protein sequences that enhance the pharmacokinetic properties of any core polypeptide to which they are linked. The invention is based on the discovery that hybrid polypeptides comprising the enhancer peptide sequences linked to a core polypepide possess enhanced pharmacokinetic properties such as increased half life. The invention further relates to methods for enhancing the pharmacokinetic properties of any core polypeptide through linkage of the enhancer peptide sequences to the core polypeptide. The core polypeptides to be used in the practice of the invention can include any pharmacologically useful peptide that can be used, for example, as a therapeutic or prophylactic reagent. In a non-limiting embodiment, the invention is demonstrated by way of example wherein a hybrid polypeptide comprising, for example, an HIV core polypeptide linked to enhancer peptide sequences, is shown to be a potent, non-cytotoxic inhibitor of HIV-1, HIV-2 and SIV infection. Additionally, the enhancer peptide sequences of the invention have been linked to a respiratory syncytial virus (RSV) core polypeptide and a luteinizing hormone receptor (LH-RH) core polypeptide. In each instance, the hybrid polypeptide was found to possess enhanced pharmacokinetic properties, and the RSV hybrid polypeptide exhibited substantial anti-RSV activity.

The Sequence Listing for this application is on duplicate compact discs labeled "Copy 1" and "Copy 2". Copy 1 and Copy 2 each contain only one file named "7872081.APP" which was created on Aug. 10, 2001 and is 645,776 bytes. The entire contents of each of the compact discs is incorporated herein by reference.

2. BACKGROUND OF THE INVENTION

Polypeptide products have a wide range of uses as therapeutic and/or prophylactic reagents for prevention and treatment of disease. Many polypeptides are able to regulate biochemical or physiological processes to either prevent disease or provide relief from symptoms associated with disease. For example, polypeptides such as viral or bacterial polypeptides have been utilized successfully as vaccines for prevention of pathological diseases. Additionally, peptides have been successfully utilized as therapeutic agents for treatment of disease symptoms. Such peptides fall into diverse categories such, for example, as hormones, enzymes, immunomodulators, serum proteins and cytokines.

For polypeptides to manifest their proper biological and therapeutic effect on the target sites, the polypeptides must be present in appropriate concentrations at the sites of action. In addition, their structural integrity must generally be maintained. Therefore, the formulation of polypeptides as drugs for therapeutic use is directed by the chemical nature and the characteristics of the polypeptides, such as their size and complexity, their conformational requirements and their often complicated stability, and solubility profiles. The pharmacokinetics of any particular therapeutic peptide is dependent on the bioavailability, distribution and clearance of said peptide.

Since many bioactive substances, such as peptides and proteins, are rapidly destroyed by the body, it is critical to develop effective systems for maintaining a steady concentration of peptide in blood circulation, to increase the efficacy of such peptides, and to minimize the incidence and severity of adverse side effects.

3. SUMMARY OF THE INVENTION

The present invention relates, first, to enhancer peptide sequences derived from various retroviral envelope (gp41) protein sequences i.e., HIV-1, HIV-2 and SIV, that enhance the pharmacokinetic properties of any core. polypeptide to which they are linked. The invention is based on the surprising result that when the disclosed enhancer peptide sequences are linked to any core polypeptide, the resulting hybrid polypeptide possesses enhanced pharmacokinetic properties including, for example, increased half life and reduced clearance rate relative to the core polypeptide alone. The present invention further relates to such hybrid polypeptides and core polypeptides.

The core polypeptides to be used in the practice of the invention can comprise any peptides which may be introduced into a living system, for example, any peptides capable of functioning as therapeutic or prophylactic reagents useful for treatment or prevention of disease. Such peptides include, for example, growth factors, hormones, cytokines, angiogenic growth factors, extracellular matrix polypeptides or polypeptides that exhibit antifusogenic and/or antiviral activity, and peptides or polypeptides that function as immunogens including, for example, viral and bacterial polypeptides.

The invention further relates to methods for enhancing the pharmacokinetic properties of any core polypeptide through linkage of the core polypeptide to the enhancer peptide sequences to form hybrid polypeptides.

The invention is demonstrated by way of examples wherein hybrid polypeptides containing an HIV core polypeptide linked to enhancer peptide sequences are shown to exhibit greatly enhanced pharmacokinetic properties and act as a potent, non-cytotoxic inhibitors of HIV-1, HIV-2 and SIV infection. The invention is further demonstrated by examples wherein hybrid polypeptides; containing an RSV core polypeptide or a luteinizing hormone polypeptide are shown to exhibit greatly enhanced pharmacokinetic properties. In addition, the RSV hybrid polypeptide exhibited substantial anti-RSV activity.

3.1. DEFINITIONS

Peptides are defined herein as organic compounds comprising two or more aminoacids covalently joined by peptide bonds. Peptides may be referred to with respect to the number of constituent natural L-amino acids, i.e., a dipeptide contains two amino acid residues, a tripeptide contains three, etc. Peptides containing ten or fewer amino acids may be referred to as oligopeptides, while those with more than ten amino acid residues are polypeptides. Such peptides may also include non-natural amino acids and any of the modifications and additional amino and carboxyl groups as are described herein.

Peptide sequences defined herein are represented by one-letter symbols for amino acid residues as follows:

A (alanine)
R (arginine),
N (asparagine)
D (aspartic acid)
C (cysteine)

Q (glutamine)
E (glutamic acid)
G (glycine)
H (histidine)
I (isoleucine)
L (leucine)
K (lysine)
M (methionine)
F (phenylalanine)
P (proline)
S (serine)
T (threonine)
W (tryptophan)
Y (tyrosine)
V (valine)
X (any amino acid)

"Enhancer peptide sequences" are defined as peptides having the following consensus amino acid sequences: "WXXWXXXI", "WXXWXXX", "WXXWXX", "WXXWX", "WXXW", "WXXXWXWX", "XXXWXWX", "XXWXWX", "XWXWX", "WXWX", "WXXXWXW", "WXXXWX", "WXXXW", "IXXXWXXW", "XXXWXXW", "XXWXXW", "XWXXW ", "XWXWXXXW", "XWXWXXX", "XWXWXX", "XWXWX", "XWXW", "WXWXXXW", or "XWXXXW", wherein X can be any amino acid, W represents tryptophan and I represents isoleucine. As discussed below, the enhancer peptide sequences of the invention also include peptide sequences that are otherwise the same as the consensus amino acid sequences but contain amino acid substitutions, insertions or deletions but which do not abolish the ability of the peptide to enhance the pharmacokinetic properties of a core peptide to which it is linked.

"Core polypeptide" as used herein, refers to any polypeptide which may be introduced into a living system and, thus, represents a bioactive molecule, for example any polypeptide that can function as a pharmacologically useful peptide for treatment or prevention of disease.

"Hybrid polypeptide" as used herein, refers to any polypeptide comprising a terminal enhancer peptide sequence and a core polypeptide.

4. BRIEF DESCRIPTION OF DRAWINGS

FIG. 1. Hybrid polypeptides. Enhancer peptide sequences derived from putative N-terminal and C-terminal interactive regions are depicted linked to a core polypeptide. The critical enhancer peptide sequences are shaded. It is to be noted that the enhancer peptide sequences indicated may be used either as N- or C- terminal additions. Further, the enhancer peptide sequences can be added to a core polypeptide in forward or reverse orientation, individually or in any of the possible combinations, to enhance pharmacokinetic properties of the peptide.

FIG. 2A. Enhancer peptide sequences derived from various envelope (gp41) protein sequences, representing the N-terminal interactive region observed in all currently published isolate sequences of HIV-1, HIV-2 and SIV. The final sequence "WXXWXXXI" (SEQ ID NO: 1475) represents a consensus sequence.

FIG. 2B. Enhancer peptide sequence variants derived from various envelope (gp4 1) protein sequences, representing the C-terminal interactive region observed in all currently published isolate sequences of HIV-1, HIV-2 and SIV. The final sequence "WXXXWXWX" (SEQ ID NO: 1515) represents a consensus sequence.

FIG. 3. Comparison of HIV-1 titres in tissues of HIV-1 9320 infected SCID-HuPBMC mice as measured by P24 Levels in HuPBMC co-culture assays. The figure shows a comparison of in vivo T20 and T1249 viral inhibition.

FIGS. 4A–4B. Plasma pharmacokinetic profile of T1249 vs T1387 core control in CD-rats following IV injection for up to 2 hrs (FIG. 4A) and 8 hrs (FIG. 4B). The T1387 polypeptide is a core polypeptide and the T1249 polypeptide is the core polypeptide linked to enhancer peptide sequences.

FIG. 5. Plasma pharmacokinetic profile of T1249 vs T20 control in CD-rats following IV administration. The T1249 polypeptide is a hybrid polypeptide of a core polypeptide (T1387) linked to enhancer peptide sequences. T20: n=4; T1249: n=3.

FIG. 6. Comparison of T20/T1249 Anti-HIV-1/IIIb activity and cytotoxicity.

FIGS. 7A–7B-1. Direct Binding of T1249 to gp41 construct M41Δ178. $^{125}$I-T1249 was HPLC purified to maximum specific activity. Saturation binding to M41Δ178 (a gp41 ectodomain fusion protein lacking the T20 amino acid sequence) immobilized in microtitre plates at 0.5 mg/ml is shown.

FIGS. 8A–8B. Time Course of T1249 Association/ Dissociation. Dissociation of bound radioligand was measured following the addition of unlabeled peptide to a final concentration of 10 $\mu$M in 1/10 total assay volume.

FIGS. 9A–B. Competition for T1249 Binding to M41Δ178. Unlabeled T1249 and T20 were titrated in the presence of a single concentration of either $^{125}$I-T1249 or $^{125}$I-T20. Ligand was added just after the unlabeled peptide to start the incubation.

FIGS. 10A–10B. Plasma pharmacokinetic profile of RSV hybrid polypeptides T1301 (10A) and T1302 (10B) vs T786 in CD rats.

FIG. 11A. Plaque Reduction Assay. Hybrid polypeptide T1293 is capable of inhibiting RSV infection with an $IC_{50}$ 2.6 $\mu$g/ml.

FIG. 11B. Plaque Reduction Assay demonstrates the ability of RSV Hybrid Polypeptides T1301, T1302 and T1303 to inhibit RSV infection.

FIGS. 12A and 12B. Plasma pharmacokinetic profile of luteinizing hormone hybrid polypeptide T1324 vs T1323 in CD male rats. The T1323 polypeptide is a luteinizing hormone core polypeptide and the T1324 polypeptide is a hybrid polypeptide comprising a core polypeptide linked to enhancer peptide sequences.

FIGS. 13A–13D. Hybrid polypeptide sequences derived from various core polypeptides. Core polypeptide sequences are shown shaded.

5. DETAILED DESCRIPTION OF THE INVENTION

Described herein are peptide sequences, referred to as enhancer peptide sequences, derived from various retroviral envelope (gp41) protein sequences that are capable of enhancing the pharmacokinetic properties of core polypeptides to which they are linked. Such enhancer peptide sequences can be utilized in methods for enhancing the pharmacokinetic properties of any core polypeptide through linkage of the enhancer peptide sequences to the core polypeptide to form a hybrid polypeptide with enhanced pharmacokinetic properties relative to the core polypeptide alone.

The core polypeptides of the hybrid polypeptides of the invention comprise any peptide which may be introduced into a living system, for example, any peptide that can function as a therapeutic or prophylactic reagent useful for treatment or prevention of disease.

5.1. HYBRID POLYPEPTIDES

The hybrid polypeptides of the invention comprise at least one enhancer peptide sequence and a core polypeptide. The enhancer peptide sequences of the invention comprise peptide sequences originally derived from various retroviral envelope (gp 41) protein sequences including HIV-1, HIV-2 and SIV. While not wishing to be bound by any particular theory, the structure of the envelope protein is such that the putative α-helix region located in the C-terminal region of the protein is believed to associate with the leucine zipper region located in the N-terminal region of the protein. Alignment of the N-terminal and C-terminal enhancer peptide sequence gp4l regions observed in all currently published isolate sequences of HIV-1, HIV-2 and SIV identified consensus amino acid sequences.

In particular the following consensus amino acid sequences were identified (the consensus sequences are listed below in forward and reverse orientations because said enhancer sequences can be utilized either in forward or reverse orientation): "WXXWXXXI", "WXXWXXX", "WXXWXX", "WXXWX", "WXXW", "WXXXWXWX", "XXXWXWX", "XXWXWX", "XWXWX", "WXWX", "WXXXWXW", "WXXXWX", "WXXXW", "IXXXWXXW", "XXXWXXW", "XXWXXW", "XWXXW", "XWXWXXXW", "XWXWXXX", "XWXWXX", "XWXWX", "XWXW", "WXWXXXW", or "XWXXXW", wherein X can be any amino acid, W represents tryptophan and I represents isoleucine. Forward orientations of consensus amino acid sequences are shown in FIGS. 1 and 2.

In a preferred embodiment of the invention, enhancer peptide sequences which may be used to enhance the pharmacokinetic properties of the resultant hybrid polypeptides comprise the enhancer sequences depicted in FIG. 2. In another preferred embodiment, enhancer peptide sequences of the invention comprise the enhancer peptide sequences depicted in FIG. 2 exhibiting conserved amino acid substitutions at one or more residues wherein said substitutions do not abolish the ability of the enhancer peptide sequence to enhance the pharmacokinetic properties of a hybrid polypeptide relative to its corresponding core polypeptide. Among the most preferred enhancer peptide sequences are ones comprising the following amino sequence: "WQEWEQKI" (SEQ ID NO: 1129) and "WASLWEWF"(SEQ ID NO:1144 residue #19–26).

The present invention further provides enhancer peptide sequences comprising amino acid sequences of FIGS. 1 and 2 that are otherwise the same, but, that said enhancer peptide sequences comprise one or more amino acid substitutions, additions (generally no greater than about 15 amino acid residues in length) or deletions (for example, amino- or terminal- truncations) which nevertheless are able to increase the pharmacokinetic properties of core polypeptides to which they are linked relative to core polypeptides without such enhancer sequences.

In particular, it is understood that certain amino acid residues comprising the consensus amino acid sequence of the enhancer peptide sequences can be replaced with other amino acid residues without significantly deleteriously affecting, and in some instances even enhancing, the activity of the peptides. Thus, also contemplated by the present invention are altered forms of the enhancer peptide sequence wherein at least one defined amino acid residue in the structure is substituted with another amino acid residue. Such amino acid substitutions may be conservative i.e., the replacing amino acid residue has physical and chemical properties (e.g., similar charge, size and/or hydrophobicity characteristics) that are similar to the amino acid residue being replaced, or non-conservative amino acid substitutions.

A critical feature affecting the activity of the peptides of the invention is their ability to increase the pharmacokinetic properties of core polypeptides to which they are linked relative to the core polypeptides above, thus it will be recognized that in preferred embodiments of the invention, the amino acid substitutions do not affect the ability of the enhancer peptides to increase the pharmacokinetic properties of the peptide. In general, such changes involve the "X" amino acid residues of the enhancer peptide consensus sequences.

In addition, the amino acid substitutions need not be, and in certain embodiments preferably are not, restricted to the genetically encoded amino acids. Indeed, the peptides may contain genetically non-encoded amino acids. Thus, in addition to the naturally occurring genetically encoded amino acids, amino acid residues in the peptides may be substituted with naturally occurring non-encoded amino acids and synthetic amino acids.

Certain commonly encountered amino acids which provide useful substitutions include, but are not limited to, β-alanine (β-Ala) and other omega-amino acids such as 3-aminopropionic acid, 2,3-diaminopropionic acid (Dpr), 4-aminobutyric acid and so forth; α-aminoisobutyric acid (Aib); ϵ-aminohexanoic acid (Aha); δ-aminovaleric acid (Ava); N-methylglycine or sarcosine (MeGly); ornithine (Orn); citrulline (Cit); t-butylalanine (t-BuA); t-butylglycine (t-BuG); N-methylisoleucine (MeIle); phenylglycine (Phg); cyclohexylalanine (Cha); norleucine (Nle); naphthylalanine (Nal); 4-chlorophenylalanine (Phe(4-Cl)); 2-fluorophenylalanine (Phe(2-F)); 3-fluorophenylalanine (Phe(3-F)); 4-fluorophenylalanine (Phe(4-F)); penicillamine (Pen); 1,2,3,4-tetrahydroisoquinoline-3-carboxylic acid (Tic); β-2-thienylalanine (Thi); methionine sulfoxide (MSO); homoarginine (hArg); N-acetyl lysine (AcLys); 2,4-diaminobutyric acid (Dbu); 2,3-diaminobutyric acid (Dab); p-aminophenylalanine (Phe($pNH_2$)); N-methyl valine (MeVal); homocysteine (hCys), homophenylalanine (hphe) and homoserine (hSer); hydroxyprdline (Hyp), homoproline (hPro), N-methylated amino acids and peptoids (N-substituted glycines).

While in most instances, the amino acids of the peptide will be substituted with L-enantiomeric amino acids, the substitutions are not limited to L-enantiomeric amino acids. Thus, also included in the definition of "mutated" or "altered" forms are those situations where an L-amino acid is replaced with an identical D-amino acid (e.g., L-Arg→D-Arg) or with a D-amino acid of the same category or subcategory (e.g., L-Arg→D-Lys), and vice versa.

It is to be understood that the present invention also contemplates peptide analogues wherein one or more amide linkage is optionally replaced with a linkage other than amide, preferably substituted amide or an isostere of amide. Thus, while the amino acid residues within peptides are generally described in terms of amino acids, and preferred embodiments of the invention are exemplified by way of peptides, one having skill in the art will recognize that in embodiments having non-amide linkages, the term "amino acid" or "residue" as used herein refers to other bifunctional moieties bearing groups similar in structure to the side chains of the amino acids. In addition the amino acid residues may be blocked or unblocked.

Additionally, one or more amide linkages can be replaced with peptidomimetic or amide mimetic moieties which do not significantly interfere with the structure or activity of the peptides. Suitable amide mimetic moieties are described, for example, in Olson et al., 1993, J. Med. Chem. 36:3049.

Enhancer peptide sequences can be used to enhance the pharmacokinetic properties of the core polypeptide as either N-terminal or C-terminal additions. While it is preferable for the enhancer peptide sequences to be utilized in a pairwise fashion, that is, preferably hybrid polypeptides comprise an enhancer peptide sequence at both the amino- and carboxy-termini, hybrid polypeptides can also comprise a single enhancer peptide, said peptide present at either the amino- or carboxy- terminus of the hybrid polypeptide. Further, the enhancer peptides can be used in either forward or reverse orientation, or in any possible combination, linked to a core polypeptide. It is noted that any of the enhancer peptides can be introduced at either the N-terminus on the C-terminus of the core polypeptide.

It is understood that the core polypeptide may be linked to the enhancer peptides via a peptide amide linkage, although linkages other than amide linkages can be utilized to join the enhancer peptide sequences to the core polypeptides. Such linkages include for example any carbon—carbon, ester or chemical bond that functions to link the enhancer peptide sequences of the invention to a core peptide.

The amino- and/or carboxy-termini of the resulting hybrid polypeptide can comprise an amino group (—NH$_2$) or a carboxy (—COOH) group, respectively. Alternatively, the hybrid polypeptide amino-terminus may, for example, represent a hydrophobic group, including but not limited to carbobenzyl, dansyl, T-butoxycarbonyl, decanoyl, napthoyl or other carbohydrate group; an acetyl group; 9-fluorenylmethoxy-carbonyl (FMOC) group; or a modified, non-naturally occurring amino acid residue. Alternatively, the hybrid polypeptide carboxy-terminus can, for example, represent an amido group; a T-buxoxycarbonyl group; or a modified non-naturally occurring amino acid residue. As a non-limiting example, the amino- and/or carboxy-termini of the resulting hybrid polypeptide can comprise any of the amino- and/or carboxy-terminal modifications depicted in the peptides shown in FIGS. 13A–D or Table 1, below.

The core polypeptides to be used in the practice of the invention comprise any polypeptide which may be introduced into a living system, for example, any polypeptide that can function as a pharmacologically useful polypeptide. Such core polypeptides may be useful for the treatment or prevention of disease. Examples of possible core polypeptides include growth factors, cytokines, therapeutic polypeptides, hormones and peptide fragments of hormones, inhibitors of cytokines, peptide growth and differentiation factors, interleukins, chemokines, interferons, colony stimulating factors, angiogenic factors and extracellular matrix proteins such as collagen, laminin and fibronectin to name a few. In addition, possible core polypeptides may include viral or bacterial polypeptides that may function either directly or as immunogens, and thus may be useful in the treatment or prevention of pathological disease.

Representative examples of hybrid polypeptides which comprise core polypeptides derived from viral protein sequences are shown in FIGS. 13A–D. Core polypeptide sequences are shaded. Core polypeptides also include, but are not limited to, the polypeptides disclosed in U.S. Pat. No. 5,464,933, U.S. Pat. No. 5,656,480 and WO 96/19495, each of which is incorporated herein by reference in its entirety.

Core polypeptide sequences can further include, but are not limited to the core polypeptide sequences depicted in FIGS. 13A–D and Table 1, below.

TABLE 1

| T No. | Sequence | Seq. ID No. |
|---|---|---|
| 1 | GIKQLQARILAVERYLKDQ | 1 |
| 2 | NNLLRAIEAQQHLLQLTVW | 2 |
| 3 | NEQELLELDKWASLWNWF | 3 |
| 4 | YTSLIHSLIEESQNQQEK | 4 |
| 5 | Ac-VWGIKQLQARILAVERYLKDQQLLGIWG-NH2 | 5 |
| 6 | QHLLQLTVWGIKQLQARILAVERYLKDQ | 6 |
| 7 | LRAIEAQQHLLQLTVWGIKQLQARILAV | 7 |
| 8 | VQQQNNLLARIEAQQHLLQLTVWGIKQL | 8 |
| 9 | RQLLSGIVQQQNNLLRAIEAQQHLLQLT | 9 |
| 10 | MTLTVQARQLLSGIVQQQNNLLRAIEAQ | 10 |
| 12 | VVSLSNGVSVLTSKVLDLKNYIDKQLL | 11 |
| 13 | LLSTNKAVVSLSNGVSVLTSKVLDLKNY | 12 |
| 15 | Ac-VLHLEGEVNKIKSALLSTNKAVVSLSNG-NH2 | 13 |
| 19 | Ac-LLSTNKAVVSLSNGVSVLTSKVLDLKNY-NH2 | 14 |
| 20 | Ac-YTSLIHSLIEESQNQQEKNEQELLELDKWASLWNWF-NH2 | 15 |
| 21 | Ac-NNLLRAIEAQQHLLQLTVWGIKQLQARILAVERYLKDQ-NH2 | 16 |
| 22 | Ac-IELSNIKENKCNGTDAKVKLIKQELDKYKNAVTELQLLMQST-NH2 | 17 |
| 23 | Ac-IELSNIKENKCNGTDAKVKLIKQELDKY-NH2 | 18 |
| 24 | Ac-ENKCNGTDAKVKLIKQELDKYKNAVTEL-NH2 | 19 |
| 25 | Ac-DAKVKLIKQELDKYKNAVTELQLLMQST-NH2 | 20 |
| 26 | Ac-CNGTDAKVKLIKQELDKYKNAVTELQLL-NH2 | 21 |
| 27 | Ac-SNIKENKCNGTDAKVKLIKQELDKYKNAVTELQLL-NH2 | 22 |
| 28 | Ac-ASGVAVSKVLHLEGEVNKIKSALLSTNKAVVSLSNGV-NH2 | 23 |
| 29 | Ac-SGVAVSKVLHLEGEVNKIKSALLSTNKAVVSLSNG-NH2 | 24 |
| 30 | Ac-VLHLEGEVNKIKSALLSTHKAVVSLSNGVSVLTSK-NH2 | 25 |
| 31 | Ac-ARKLQRMKQLEDKVEELLSKNYHYLENEVARLKKLV-NH2 | 26 |
| 32 | Ac-RMKQLEDKVEELLSKNYHYLENEVARLKKLVGER-NH2 | 27 |
| 33 | Ac-VQQQNNLLRAIEAQQHLLQLTVWGIKQL-NH2 | 28 |
| 34 | Ac-LRAIEAQQHLLQLTVWGIKQLQARILAV-NH2 | 29 |
| 35 | Ac-QHLLQLTVWGIKQLQARILAVERYLKDQ-NH2 | 30 |

TABLE 1-continued

| T No. | Sequence | Seq. ID No. |
|---|---|---|
| 36 | Ac-RQLLSGIVQQQNNLLRAIEAQQHLLQLT-NH2 | 31 |
| 37 | Ac-MTLTVQARQLLSGIVQQQNNLLRAIEAQ-NH2 | 32 |
| 38 | Ac-AKQARSDIEKLKEAIRDTNKAVQSVQSS-NH2 | 33 |
| 39 | Ac-AAVALVEAKQARSDIEKLKEAIRDTNKAVQSVQSS-NH2 | 34 |
| 40 | Ac-AKQARSDIEKLKEAIRDTNKAVQSVQSSIGNLIVA-NH2 | 35 |
| 41 | Ac-GTIALGVATSAQITAAVALVEAKQARSD-NH2 | 36 |
| 42 | Ac-ATSAQITAAVALVEAKQARSDIEKLKEA-NH2 | 37 |
| 43 | Ac-AAVALVEAKQARSDIEKLKEAIRDTNKA-NH2 | 38 |
| 44 | Ac-IEKLKEAIRDTNKAVQSVQSSIGNLIVA-NH2 | 40 |
| 45 | Ac-IRDTNKAVQSVQSSIGNLIVAIKSVQDY-NH2 | 41 |
| 46 | Ac-AVQSVQSSIGNLIVAIKSVQDYVNKEIV-NH2 | 42 |
| 47 | Ac-QARQLLSGIVQQQNNLLRAIEAQQHLLQLTVWGIKQLARILAVERYLKDQ-NH2 | 43 |
| 48 | Ac-QARQLLSGIVQQQNNLLRAIEAQQHLLQ-NH2 | 43 |
| 49 | Ac-MTWMEMDREINNYTSLIGSLIEESQNQQEKNEQELLELDKWASLWNWF-NH2 | 45 |
| 50 | Ac-WMEWDRENNYTSLIGSLIEESQNQQEKNEQELLE-NH2 | 46 |
| 51 | Ac-INNYTSLIGSLIEESQNQQEKNEQELLE-NH2 | 47 |
| 52 | Ac-INNYTSLIGSLIEESQNQQEKNEQELLELDKWASL-NH2 | 48 |
| 53 | Ac-EWDREINNYTSLIGSLIEESQNQQEKNEQEGGC-NH2 | 49 |
| 54 | Ac-QSRTLLAGIVQQQQLLDVVKRQQELLR-NH2 | 50 |
| 55 | Ac-NNDTWQEWERKVDFLEENITALLEEAQIQQEKNMYELQKLNSWD-NH2 | 51 |
| 56 | Ac-WQEWERKVDFLEENITALLEEAQIQQEK-NH2 | 52 |
| 57 | Ac-VDFLEENITALLEEAQIQQEKNMYELQK-NH2 | 53 |
| 58 | Ac-ITALLEEAQIQQEKNMYELQKLNSWDVF-NH2 | 54 |
| 59 | Ac-SSESFTLLEQWNNWKLQLAEQWLEQINEKHYLEDIS-NH2 | 55 |
| 60 | Ac-DKWASLWNWF-NH2 | 56 |
| 61 | Ac-NEQELLELDKWASLWNWF-NH2 | 57 |
| 62 | Ac-EKNEQELLELDKWASLWNWF-NH2 | 58 |
| 63 | Ac-NQQEKNEQELLELDKWASLWNWF-NH2 | 59 |
| 64 | Ac-ESQNQQEKNEQELLELDKWASLWNWF-NH2 | 60 |
| 65 | Ac-LIHSLIEESQNQQEKNEQELLELDKWASLWNWF-NH2 | 61 |
| 66 | Ac-NDQKKLMSNNVQIVRQQSYSIMSIIKEE-NH2 | 62 |
| 67 | Ac-DEFDASISQVNEKINQSLAFIRKSDELL-NH2 | 63 |
| 68 | Ac-VSKGYSALRTGWYTSVITIELSNIKEN-NH2 | 64 |
| 69 | Ac-VVSLSNGVSVLTSKVLDLKNYIDKQLL-NH2 | 65 |
| 70 | Ac-VNKIKSALLSTNKAVVSLSNGVSVLTSK-NH2 | 66 |
| 71 | Ac-PIINFYDPLVFPSDEFDASISQVNEKINQSLAFIR-NH2 | 67 |
| 72 | Ac-NLVYAQLQFTYDTLRGYINRALAQIAEA-NH2 | 68 |
| 73 | Ac-LNQVDLTETLERYQQRLNTYALVSKDASYRS-NH2 | 69 |
| 74 | Ac-ELLVLKKAQLNRHSYLKDSDFLDAALD-NH2 | 70 |
| 75 | Ac-LAEAGEESVTEDTEREDTEEEREDEEE-NH2 | 71 |
| 76 | Ac-ALLAEAGEESVTEDTEREDTEEEREDEEEENEART-NH2 | 72 |
| 77 | Ac-ETERSVDLVAALLAEAGEESVTEDTEREDTEEERE-NH2 | 73 |
| 78 | Ac-EESVTEDTEREDTEEEREDEEEENEART-NH2 | 74 |
| 79 | Ac-VDLVAALLAEAGEESVTEDTEREDTEEE-NH2 | 75 |
| 80 | Ac-NSETERSVDLVAALLAEAGEESVTE-NH2 | 76 |
| 81 | Ac-DISYAQLQFTYDVLKDYINDALRNIMDA-NH2 | 77 |
| 82 | Ac-SNVFSKDEIMREYNSQKQHIRTLSAKVNDN-NH2 | 78 |
| 83 | Biotin-YTSLIHSLIEESQNQQEKNEQELLELDKWASLWNWF-NH2 | 1076 |
| 84 | Dig-YTSLIHSLIEESQNQQEKNEQELLELDKWASLWNWF-NH2 | 1076 |
| 85 | Biotin-NNLLRAIEAQQHLLQLTVWGIKQLQARILAVERYLKDQ-NH2 | 16 |
| 86 | Dig-NNLLRAIEAQQHLLQLTVWGIKQLQARILAVERYLKDQ-NH2 | 16 |
| 87 | Ac-VLHQLNIQLKQYLETQERLLAGNRIAARQLLQIWKDVA-NH2 | 83 |
| 88 | Ac-LWHEQLLNTAQRAGLQLQLINQALAVREKVLIRYDIQK-NH2 | 84 |
| 89 | Ac-LLDNFESTWEQSKELWEQQEISIQNLHKSALQEYW-NH2 | 85 |
| 90 | Ac-LSNLLQISNNSDEWLEALEIEHEKWKLTQWQSYEQF-NH2 | 86 |
| 91 | Ac-KLEALEGKLEALEGKLEALEGKLEALEGKLEALEGK-NH2 | 87 |
| 92 | Ac-ELRALRGELRALRGELRALRGELRALRGK-NH2 | 88 |
| 93 | Ac-ELKAKELEGEGLAEGEEALKGLLEKAAKLEGLELLK-NH2 | 89 |
| 94 | Ac-WEAAAREAAAREAAAREAAARA-NH2 | 90 |
| 95 | Ac-YTSLIHSLIEESQNQQEKNEQELLELDKWASLWNAF-NH2 | 91 |
| 96 | Ac-YTSLIHSLIEESQNQQEKNEQELLELDKWASLANWF-NH2 | 92 |
| 97 | Ac-YTSLIHSLIEESQNQQEKNQQELLELDKWASLWNWF-NH2 | 93 |
| 98 | Ac-YTSLIHSLIEESQNQQEKNEQELLQLDKWASLWNWF-NH2 | 94 |
| 99 | Ac-YTSLIHSLIEESQNQQEKNQQELLQLDKWASLWNWF-NH2 | 95 |
| 100 | Ac-RMKQLEDKVEELLSKNYHLENEVARLKKLVGER-NH2 | 96 |
| 101 | Ac-QQLLQLTVWGIKQLQARILAVERYLKNQ-NH2 | 97 |
| 102 | Ac-NEQELLELDKWASLWNWF-NH2 | 98 |
| 103 | Ac-YTSLIQSLIEESQNQQEKNEQELLELDKWASLWNWF-NH2 | 99 |
| 104 | Ac-IINFYDPLVFPSDEFDASISQVNEKINQSLAFIRK-NH2 | 100 |
| 105 | Ac-INFYDPLVFPSDEFDASISQVNEKINQSLAFIRKS-NH2 | 101 |
| 106 | Ac-NFYDPLVFPSDEFDASISQVNEKINQSLAFIRKSD-NH2 | 102 |
| 107 | Ac-FYDPLVFPSDEFDASISQVNEKINQSLAFIRKSDE-NH2 | 103 |
| 108 | Ac-YDPLVFPSDEFDASISQVNEKINQSLAFIRKSDEL-NH2 | 104 |
| 109 | Ac-DPLVFPSDEFDASISQVNEKINQSLAFIRKSDELL-NH2 | 105 |
| 110 | Ac-PLVFPSDEFDASISQVNEKINQSLAFIRKSDELLH-NH2 | 106 |
| 111 | Ac-LVFPSDEFDASISQVNEKINQSLAFIRKSDELLHN-NH2 | 107 |

TABLE 1-continued

| T No. | Sequence | Seq. ID No. |
|---|---|---|
| 112 | Ac-VFPSDEFDASISQVNEKINQSLAFIRKSDELLHNV-NH2 | 108 |
| 113 | Ac-FPSDEFDASISQVNEKINQSLAFIRKSDELLHNVN-NH2 | 109 |
| 114 | Ac-PSDEFDASISQVNEKINQSLAFIRKSDELLHNVNA-NH2 | 110 |
| 115 | Ac-SDEFDASISQVNEKINQSLAFIRKSDELLHNVNAG-NH2 | 111 |
| 116 | Ac-DEFDASISQVNEKINQSLAFIRKSDELLHNVNAGK-NH2 | 112 |
| 117 | Ac-EFDASISQVNEKINQSLAFIRKSDELLHNVNAGKS-NH2 | 113 |
| 118 | Ac-FDASISQVNEKINQSLAFIRKSDELLHNVNAGKST-NH2 | 114 |
| 119 | Ac-DASISQVNEKINQSLAFIRKSDELLHNVNAGKSTT-NH2 | 115 |
| 120 | Ac-ASGVAVSKVLHLEGEVNKIKSALLSTNKAVVSLSN-NH2 | 116 |
| 121 | Ac-SGVAVSKVLHLEGEVNKIKSALLSTNKAVVSLSNG-NH2 | 117 |
| 122 | Ac-GVAVSKVLHLEGEVNKIKSALLSTNKAVVSLSNGV-NH2 | 118 |
| 123 | Ac-VAVSKVLHLEGEVNKIKSALLSTNKAVVSLSNGVS-NH2 | 119 |
| 124 | Ac-AVSKVLHLEGEVNKIKSALLSTNKAVVSLSNGVSV-NH2 | 120 |
| 125 | Ac-VSKVLHLEGEVNKIKSALLSTNKAVVSLSNGVSVL-NH2 | 121 |
| 126 | Ac-SKVLHLEGEVNKIKSALLSTNKAVVSLSNGVSVLT-NH2 | 122 |
| 127 | Ac-KVLHLEGEVNKIKSALLSTNKAVVSLSNGVSVLTS-NH2 | 123 |
| 128 | Ac-VLHLEGEVNKIKSALLSTNKAVVSLSNGVSVLTSK-NH2 | 124 |
| 129 | Ac-LHLEGEVNKIKSALLSTNKAVVSLSNGVSVLTSKV-NH2 | 125 |
| 130 | Ac-HLEGEVNKIKSALLSTNKAVVSLSNGVSVLTSKVL-NH2 | 126 |
| 131 | Ac-LEGEVNKIKSALLSTNKAVVSLSNGVSVLTSKVLD-NH2 | 127 |
| 132 | Ac-EGEVNKIKSALLSTNKAVVSLSNGVSVLTSKVLDL-NH2 | 128 |
| 133 | Ac-GEVNKIKSALLSTNKAVVSLSNGVSVLTSKVLDLK-NH2 | 129 |
| 134 | Ac-EVNKIKSALLSTNKAVVSLSNGVSVLTSKVLDLKN-NH2 | 130 |
| 135 | Ac-VNKIKSALLSTNKAVVSLSNGVSVLTSKVLDLKNY-NH2 | 131 |
| 136 | Ac-NKIKSALLSTNKAVVSLSNGVSVLTSKVLDLKNYI-NH2 | 132 |
| 137 | Ac-KIKSALLSTNKAVVSLSNGVSVLTSKVLDLKNYID-NH2 | 133 |
| 138 | Ac-IKSALLSTNKAVVSLSNGVSVLTSKVLDLKNYIDK-NH2 | 134 |
| 139 | Ac-KSALLSTNKAVVSLSNGVSVLTSKVLDLKNYIDKQ-NH2 | 135 |
| 140 | Ac-SALLSTNKAVVSLSNGVSVLTSKVLDLKNYIDKQL-NH2 | 136 |
| 141 | Ac-ALLSTNKAVVSLSNGVSVLTSKVLDLKNYIDKQLL-NH2 | 137 |
| 142 | Ac-YTSVITIELSNIKENKCNGTDAKVKLIKQELDKYK-NH2 | 138 |
| 143 | Ac-TSVITIELSNIKENKCNGTDAKVKLIKQELDKYKN-NH2 | 139 |
| 144 | Ac-SVITIELSNIKENKCNGTDAKVKLIKQELDKYKNA-NH2 | 140 |
| 145 | Ac-VITIELSNIKENKCNGTDAKVKLIKQELDKYKNAV-NH2 | 141 |
| 146 | Ac-ITIELSNIKENKCNGTDAKVKLIKQELDKYKNAVT-NH2 | 142 |
| 147 | Ac-TIELSNIKENKCNGTDAKVKLIKQELDKYKNAVTE-NH2 | 143 |
| 148 | Ac-IELSNIKENKCNGTDAKVKLIKQELDKYKNAVTEL-NH2 | 144 |
| 149 | Ac-ELSNIKENKCNGTDAKVKLIKQELDKYKNAVTELQ-NH2 | 145 |
| 150 | Ac-LSNIKENKCNGTDAKVKLIKQELDKYKNAVTELQL-NH2 | 146 |
| 151 | Ac-SNIKENKCNGTDAKVKLIKQELDKYKNAVTELQLL-NH2 | 147 |
| 152 | Ac-NIKENKCNGTDAKVKLIKQELDKYKNAVTELQLLM-NH2 | 148 |
| 153 | Ac-IKENKCNGTDAKVKLIKQELDKYKNAVTELQLLMQ-NH2 | 149 |
| 154 | Ac-KENKCNGTDAKVKLIKQELDKYKNAVTELQLLMQS-NH2 | 150 |
| 155 | Ac-ENKCNGTDAKVKLIKQELDKYKNAVTELQLLMQST-NH2 | 151 |
| 156 | Ac-LLDNFESTWEQSKELWELQEISIQNLHKSALQEYWN-NH2 | 152 |
| 157 | Ac-ALGVATSAQITAAVALVEAKQARSDIEKLKEAIRD-NH2 | 153 |
| 158 | Ac-LGVATSAQITAAVALVEAKQARSDIEKLKEAIRDT-NH2 | 154 |
| 159 | Ac-GVATSAQITAAVALVEAKQARSDIEKLKEAIRDTN-NH2 | 155 |
| 160 | Ac-VATSAQITAAVALVEAKQARSDIEKLKEAIRDTNK-NH2 | 156 |
| 161 | Ac-ATSAQITAAVALVEAKQARSDIEKLKEAIRDTNKA-NH2 | 157 |
| 162 | Ac-TSAQITAAVALVEAKQARSDIEKLKEAIRDTNKAV-NH2 | 158 |
| 163 | Ac-SAQITAAVALVEAKQARSDIEKLKEAIRDTNKAVQ-NH2 | 159 |
| 164 | Ac-AQITAAVALVEAKQARSDIEKLKEAIRDTNKAVQS-NH2 | 160 |
| 165 | Ac-QITAAVALVEAKQARSDIEKLKEAIRDTNKAVQSV-NH2 | 161 |
| 166 | Ac-ITAAVALVEAKQARSDIEKLKEAIRDTNKAVQSVQ-NH2 | 162 |
| 167 | Ac-TAAVALVEAKQARSDIEKLKEAIRDTNKAVQSVQS-NH2 | 163 |
| 168 | Ac-AAVALVEAKQARSDIEKLKEAIRDTNKAVQSVQSS-NH2 | 164 |
| 169 | Ac-AVALVEAKQARSDIEKLKEAIRDTNKAVQSVQSSI-NH2 | 165 |
| 170 | Ac-VALVEAKQARSDIEKLKEAIRDTNKAVQSVQSSIG-NH2 | 166 |
| 171 | Ac-ALVEAKQARSDIEKLKEAIRDTNKAVQSVQSSIGN-NH2 | 167 |
| 172 | Ac-LVEAKQARSDIEKLKEAIRDTNKAVQSVQSSIGNL-NH2 | 168 |
| 173 | Ac-VEAKQARSDIEKLKEAIRDTNKAVQSVQSSIGNLI-NH2 | 169 |
| 174 | Ac-EAKQARSDIEKLKEAIRDTNKAVQSVQSSIGNLIV-NH2 | 170 |
| 175 | Ac-KQARSDIEKLKEAIRDTNKAVQSVQSSIGNLIVAI-NH2 | 171 |
| 176 | Ac-QARSDIEKLKEAIRDTNKAVQSVQSSIGNLIVAIK-NH2 | 173 |
| 177 | Ac-ARSDIEKLKEAIRDTNKAVQSVQSSIGNLIVAIKS-NH2 | 174 |
| 178 | Ac-RSDIEKLKEAIRDTNKAVQSVQSSIGNLIVAIKSV-NH2 | 175 |
| 179 | Ac-SDIEKLKEAIRDTNKAVQSVQSSIGNLIVAIKSVQ-NH2 | 176 |
| 180 | Ac-DIEKLKEAIRDTNKAVQSVQSSIGNLIVAIKSVQD-NH2 | 177 |
| 181 | Ac-IEKLKEAIRDTNKAVQSVQSSIGNLIVAIKSVQDY-NH2 | 178 |
| 182 | Ac-EKLKEAIRDTNKAVQSVQSSIGNLIVAIKSVQDYV-NH2 | 179 |
| 183 | Ac-KLKEAIRDTNKAVQSVQSSIGNLIVAIKSVQDYVN-NH2 | 180 |
| 184 | Ac-LKEAIRDTNKAVQSVQSSIGNLIVAIKSVQDYVNK-NH2 | 181 |
| 185 | Ac-KEAIRDTNKAVQSVQSSIGNLIVAIKSVQDYVNKE-NH2 | 182 |
| 186 | Ac-EAIRDTNKAVQSVQSSIGNLIVAIKSVQDYVNKEI-NH2 | 183 |
| 187 | Ac-AIRDTNKAVQSVQSSIGNLIVAIKSVQDYVNKEIV-NH2 | 184 |

TABLE 1-continued

| T No. | Sequence | Seq. ID No. |
|---|---|---|
| 188 | Ac-IRDTNKAVQSVQSSIGNLIVAIKSVQDYVNKEIV-NH2 | 185 |
| 189 | Ac-YTPNDITLNNSVALDPIDISIELNKAKSDLEESKE-NH2 | 186 |
| 190 | Ac-TPNDITLNNSVALDPIDISIELNKAKSDLEESKEW-NH2 | 187 |
| 191 | Ac-PNDITLNNSVALDPIDISIELNKAKSDLEESKEWI-NH2 | 188 |
| 192 | Ac-NDITLNNSVALDPIDISIELNKAKSDLEESKEWIR-NH2 | 189 |
| 193 | Ac-DITLNNSVALDPIDISIELNKAKSDLEESKEWIRR-NH2 | 190 |
| 194 | Ac-ITLNNSVALDPIDISIELNKAKSDLEESKEWIRRS-NH2 | 191 |
| 195 | Ac-TLNNSVALDPIDISIELNKAKSDLEESKEWIRRSN-NH2 | 192 |
| 196 | Ac-LNNSVALDPIDISIELNKAKSDLEESKEWIRRSNQ-NH2 | 193 |
| 197 | Ac-NNSVALDPIDISIELNKAKSDLEESKEWIRRSNQK-NH2 | 194 |
| 198 | Ac-NSVALDPIDISIELNKAKSDLEESKEWIRRSNQKL-NH2 | 195 |
| 200 | Ac-SVALDPIDISIELNKAKSDLEESKEWIRRSNQKLD-NH2 | 196 |
| 201 | Ac-VALDPIDISIELNKAKSDLEESKEWIRRSNQKLDS-NH2 | 197 |
| 202 | Ac-ALDPIDISIELNKAKSDLEESKEWIRRSNQKLDSI-NH2 | 198 |
| 203 | Ac-LDPIDISIELNKAKSDLEESKEWIRRSNQKLDSIG-NH2 | 199 |
| 204 | Ac-DPIDISIELNKAKSDLEESKEWIRRSNQKLDSIGN-NH2 | 200 |
| 205 | Ac-PIDISIELNKAKSDLEESKEWIRRSNQKLDSIGNW-NH2 | 201 |
| 206 | Ac-IDISIELNKAKSDLEESKEWIRRSNQKLDSIGNWH-NH2 | 202 |
| 207 | Ac-DISIELNKAKSDLEESKEWIRRSNQKLDSIGNWHQ-NH2 | 203 |
| 208 | Ac-ISIELNKAKSDLEESKEWIRRSNQKLDSIGNWHQS-NH2 | 204 |
| 209 | Ac-SIELNKAKSDLEESKEWIRRSNQKLDSIGNWHQSS-NH2 | 205 |
| 210 | Ac-IELNKAKSDLEESKEWIRRSNQKLDSIGNWHQSST-NH2 | 206 |
| 211 | Ac-ELNKAKSDLEESKEWIRRSNQKLDSIGNWHQSSTT-NH2 | 207 |
| 212 | Ac-ELRALRGELRALRGELRALRGELRALRGELRALRGK-NH2 | 208 |
| 213 | Ac-YTSLIHSLIEESQNQQQKNEQELLELDKWASLWNWF-NH2 | 209 |
| 214 | Ac-YTSLIHSLIEESQNQQEKNEQELLELNKWASLWNWF-NH2 | 210 |
| 215 | Ac-YTSLIHSLIEQSQNQQEKNEQELLELDKWASLWNWF-NH2 | 211 |
| 216 | Ac-YTSLIHSLIQESQNQQEKNEQELLELDKWASLWNWF-NH2 | 212 |
| 217 | Ac-YTSLIHSLIQQSQNQQQKNQQQLLQLNKWASLWNWF-NH2 | 213 |
| 218 | Ac-EQELLELDKWASLWNWF-NH2 | 214 |
| 219 | Ac-QELLELDKWASLWNWF-NH2 | 215 |
| 220 | Ac-ELLELDKWASLWNWF-NH2 | 216 |
| 221 | Ac-LELDKWASLWNWF-NH2 | 218 |
| 222 | Ac-ELDKWASLWNWF-NH2 | 219 |
| 226 | Ac-WASLWNWF-NH2 | 223 |
| 227 | Ac-ASLWNWF-NH2 | 224 |
| 229 | Ac-YTSLIHSLIEESQNQQEKNEQELLELDKWASLANAA-NH2 | 226 |
| 230 | Ac-YTSLIHSLIEESQNQQEKNEQQLLELDKWASLWNWF-NH2 | 227 |
| 231 | Ac-YTSLIQSLIEESQNQQEKNQQELLELDKWASLWNWF-NH2 | 228 |
| 234 | Ac-EAAAREAAAREAAARLELDKWASLWNWF-NH2 | 231 |
| 236 | Ac-PSLRDPISAEISIQALSYALGGDINKVLEKLGYSG-NH2 | 233 |
| 237 | Ac-SLRDPISAEISIQALSYALGGDINKVLEKLGYSGG-NH2 | 234 |
| 238 | Ac-LRDPISAEISIQALSYALGGDINKVLEKLGYSGGD-NH2 | 235 |
| 239 | Ac-RDPISAEISIQALSYALGGDINKVLEKLGYSGGDL-NH2 | 236 |
| 240 | Ac-DPISAEISIQALSYALGGDINKVLEKLGYSGGDLL-NH2 | 237 |
| 241 | Ac-PISAEISIQALSYALGGDINKVLEKLGYSGGDLLG-NH2 | 238 |
| 242 | Ac-ISAEISIQALSYALGGDINKVLEKLGYSGGDLLGI-NH2 | 239 |
| 243 | Ac-SAEISIQALSYALGGDINKVLEKLGYSGGDLLGIL-NH2 | 240 |
| 244 | Ac-AEISIQALSYALGGDINKVLEKLGYSGGDLLGILE-NH2 | 241 |
| 245 | Ac-EISIQALSYALGGDINKVLEKLGYSGGDLLGILES-NH2 | 242 |
| 246 | Ac-ISIQALSYALGGDINKVLEKLGYSGGDLLGILESR-NH2 | 243 |
| 247 | Ac-SIQALSYALGGDINKVLEKLGYSGGDLLGILESRG-NH2 | 244 |
| 248 | Ac-IQALSYALGGDINKVLEKLGYSGGDLLGILESRGI-NH2 | 245 |
| 249 | Ac-QALSYALGGDINKVLEKLGYSGGDLLGILESRGIK-NH2 | 246 |
| 250 | Ac-ALSYALGGDINKVLEKLGYSGGDLLGILESRGIKA-NH2 | 247 |
| 251 | Ac-LSYALGGDINKVLEKLGYSGGDLLGILESRGIKAR-NH2 | 248 |
| 252 | Ac-PDAVYLHRIDLGPPTSLERLDVGTNLGNAIAKLED-NH2 | 249 |
| 253 | Ac-DAVYLHRIDLGPPISLERLDVGTNLGNAIAKLEDA-NH2 | 250 |
| 254 | Ac-AVYLHRIDLGPPISLERLDVGTNLGNAIAKLEDAK-NH2 | 251 |
| 255 | Ac-VYLHRIDLGPPISLERLDVGTNLGNAIAKLEDAKE-NH2 | 252 |
| 256 | Ac-YLHRIDLGPPISLERLDVGTNLGNAIAKLEDAKEL-NH2 | 253 |
| 257 | Ac-LHRIDLGPPISLERLDVGTNLGNAIAKLEDAKELL-NH2 | 254 |
| 258 | Ac-HRIDLGPPISLERLDVGTNLGNAIAKLEDAKELLE-NH2 | 255 |
| 259 | Ac-RIDLGPPISLERLDVGTNLGNAIAKLEDAKELLES-NH2 | 256 |
| 260 | Ac-IDLGPPISLERLDVGTNLGNAIAKLEDAKELLESS-NH2 | 257 |
| 261 | Ac-DLGPPISLERLDVGTNLGNAIAKLEDAKELLESSD-NH2 | 258 |
| 262 | Ac-LGPPISLERLDVGTNLGNAIAKLEDAKELLESSDQ-NH2 | 259 |
| 263 | Ac-GPPISLERLDVGTNLGNAIAKLEDAKELLESSDQI-NH2 | 260 |
| 264 | Ac-PPISLERLDVGTNLGNAIAKLEDAKELLESSDQIL-NH2 | 261 |
| 265 | Ac-PISLERLDVGTNLGNAIAKLEDAKELLESSDQILR-NH2 | 262 |
| 266 | Ac-ISLERLDVGTNLGNAIAKLEDAKELLESSDQILRS-NH2 | 263 |
| 267 | Ac-SLERLDVGTNLGNAIAKLEDAKELLESSDQILRSM-NH2 | 264 |
| 268 | Ac-LERLDVGTNLGNAIAKLEDAKELLESSDQILRSMK-NH2 | 265 |
| 269 | Ac-EWIRRSNQKLDSI-NH2 | 266 |
| 270 | Ac-LELDKWASLANAF-NH2 | 267 |
| 271 | Ac-LELDKWASLFNFF-NH2 | 268 |

TABLE 1-continued

| T No. | Sequence | Seq. ID No. |
|---|---|---|
| 272 | Ac-LELDKWASLANWF-NH2 | 269 |
| 273 | Ac-LELDKWASLWNAF-NH2 | 270 |
| 274 | Ac-ELGNVNNSISNALDKLEESNSKLDKVNVKLTSTSA-NH2 | 271 |
| 275 | Ac-TELGNVNNSISNALDKLEESNSKLDKVNVKLTSTS-NH2 | 282 |
| 276 | Ac-STELGNVNNSISNALDKLEESNSKLDKVNVKLTST-NH2 | 273 |
| 277 | Ac-ISTELGNVNNSISNALDKLEESNSKLDKVNVKLTS-NH2 | 274 |
| 278 | Ac-DISTELGNVNNSISNALDKLEESNSKLDKVNVKLT-NH2 | 275 |
| 279 | Ac-LDISTELGNVNNSISNALDKLEESNSKLDKVNVKL-NH2 | 276 |
| 280 | Ac-NLDISTELGNVNNSISNALDKLEESNSKLDKVNVK-NH2 | 277 |
| 281 | Ac-GNLDISTELGNVNNSISNALDKLEESNSKLDKVNV-NH2 | 278 |
| 282 | Ac-TGNLDISTELGNVNNSISNALDKLEESNSKLDKVN-NH2 | 279 |
| 283 | Ac-VTGNLDISTELGNVNNSISNALDKLEESNSKLDKV-NH2 | 280 |
| 284 | Ac-IVTGNLDISTELGNVNNSISNALDKLEESNSKLDK-NH2 | 281 |
| 285 | Ac-VIVTGNLDISTELGNVNNSISNALDKLEESNSKLD-NH2 | 282 |
| 286 | Ac-QVIVTGNLDISTELGNVNNSISNALDKLEESNSKL-NH2 | 283 |
| 287 | Ac-SQVIVTGNLDISTELGNVNNSISNALDKLEESNSK-NH2 | 284 |
| 288 | Ac-DSQVIVTGNLDISTELGNVNNSISNALDKLEESNS-NH2 | 285 |
| 289 | Ac-LDSQVIVTGNLDISTELGNVNNSISNALDKLEESN-NH2 | 286 |
| 290 | Ac-ILDSQVIVTGNLDISTELGNVNNSISNALDKLEES-NH2 | 287 |
| 291 | Ac-SILDSQVIVTGNLDISTELGNVNNSISNALDKLEE-NH2 | 288 |
| 292 | Ac-ISILDSQVIVTGNLDISTELGNVNNSISNALDKLE-NH2 | 289 |
| 293 | Ac-NISILDSQVIVTGNLDISTELGNVNNSISNALDKL-NH2 | 290 |
| 294 | Ac-KNISILDSQVIVTGNLDISTELGNVNNSISNALDK-NH2 | 291 |
| 295 | Ac-QKNISILDSQVIVTGNLDISTELGNVNNSISNALD-NH2 | 292 |
| 296 | Ac-YQKNISILDSQVTVTGNLDISTELGNVNNSISNAL-NH2 | 293 |
| 297 | Ac-TYQKNISILDSQVIVTGNLDISTELGNVNNSISNA-NH2 | 294 |
| 298 | Ac-ATYQKNISILDSQVIVTGNLDISTELGNVNNSISN-NH2 | 295 |
| 299 | Ac-DATYQKNISILDSQVIVTGNLDISTELGNVNNSIS-NH2 | 296 |
| 300 | Ac-FDATYQKNISILDSQVIVTGNLDISTELGNVNNSI-NH2 | 297 |
| 301 | Ac-EFDATYQKNISILDSQVIVTGNLDISTELGNVNNS-NH2 | 298 |
| 302 | Ac-GEFDATYQKNISILDSQVIVTGNLDISTELGNVNN-NH2 | 299 |
| 303 | Ac-SGEFDATYQKNISILDSQVIVTGNLDISTELGNVN-NH2 | 300 |
| 304 | Ac-LSGEFDATYQKNISILDSQVIVTGNLDISTELGNV-NH2 | 301 |
| 305 | Ac-RLSGEFDATYQKNISILDSQVIVTGNLDISTELGN-NH2 | 302 |
| 306 | Ac-LRLSGEFDATYQKNISILDSQVIVTGNLDISTELG-NH2 | 303 |
| 307 | Ac-TLRLSGEFDATYQKNISILDSQVIVTGNLDISTEL-NH2 | 304 |
| 308 | Ac-ITLRLSGEFDATYQKNISILDSQVIVTGNLDISTE-NH2 | 305 |
| 309 | Ac-GITLRLSGEFDATYQKNISILDSQVIVTGNLDIST-NH2 | 306 |
| 310 | Ac-TATIEAVHEVTDGLSQLAVAVGKMQQFVNDQFNNT-NH2 | 307 |
| 311 | Ac-ITATIEAVHEVTDGLSQLAVAVGKMQQFVNDQFNN-NH2 | 308 |
| 312 | Ac-SITATIEAVHEVTDGLSQLAVAVGKMQQFVNDQFN-NH2 | 309 |
| 313 | Ac-KESITATIEAVHEVTDGLSQLAVAVGKMQQFVNDQ-NH2 | 310 |
| 314 | Ac-LKESITATIEAVHEVTDGLSQLAVAVGKMQQFVND-NH2 | 311 |
| 315 | Ac-RLKESITATIEAVHEVTDGLSQLAVAVGKMQQFVN-NH2 | 312 |
| 316 | Ac-LRLKESITATIEAVHEVTDGLSQLAVAVGKMQQFV-NH2 | 313 |
| 317 | Ac-ILRLKESITATIEAVHEVTDGLSQLAVAVGKMQQF-NH2 | 314 |
| 318 | Ac-NILRLKESITATIEAVHEVTDGLSQLAVAVGKMQQ-NH2 | 315 |
| 319 | Ac-ANILRLKESITATIEAVHEVTDGLSQLAVAVGKMQ-NH2 | 316 |
| 320 | Ac-AANILRLKESITATIEAVHEVTDGLSQLAVAVGKM-NH2 | 317 |
| 321 | Ac-HKCDDECMNSVKNGTYDYPKYEEESKLNRNFIKGV-NH2 | 318 |
| 322 | Ac-KCDDECMNSVKNGTYDYPKYEEESKLNRNEIKGVK-NH2 | 319 |
| 323 | Ac-CDDECMNSVKNGTYDYPKYEEESKLNRNEIKGVKL-NH2 | 320 |
| 324 | Ac-DDECMNSVKNGTYDYPKYEEESKLNRNEIKGVKLS-NH2 | 321 |
| 325 | Ac-DECMNSVKNGTYDYPKYEEESKLNRNEIKGVKLSS-NH2 | 322 |
| 326 | Ac-ECMNSVKNGTYDYPKYEEESKLNRNEIKGVKLSSM-NH2 | 323 |
| 327 | Ac-CMNSVKNGTYDYPKYEEESKLNRNEIKGVKLSSMG-NH2 | 324 |
| 328 | Ac-MNSVKNGTYDYPKYEEESKLNRNEIKGVKLSSMGV-NH2 | 325 |
| 329 | Ac-NSVKNGTYDYPKYEEESKLNRNEIKGVKLSSMGVY-NH2 | 326 |
| 330 | Ac-SVKNGTYDYPKYEEESKLNRNEIKGVKLSSMGVYQ-NH2 | 327 |
| 331 | Ac-VKNGTYDYPKYEEESKLNRNEIKGVKLSSMGVYQI-NH2 | 328 |
| 332 | Ac-KNGTYDYPKYEEESKLNRNEIKGVKLSSMGVYQIL-NH2 | 329 |
| 333 | Ac-AFIRKSDELLHNV-NH2 | 330 |
| 334 | Ac-VVLAGAALGVATAAQITAGIALHQSMLNSQAIDNL-NH2 | 331 |
| 335 | Ac-VLAGAALGVATAAQITAGIALHQSMLNSQAIDNLR-NH2 | 332 |
| 336 | Ac-LAGAALGVATAAQITAGIALHQSMLNSQAIDNLRA-NH2 | 333 |
| 337 | Ac-AGAALGVATAAQITAGIALHQSMLNSQAIDNLRAS-NH2 | 334 |
| 338 | Ac-GAALGVATAAQITAGIALHQSMLNSQAIDNLRASL-NH2 | 335 |
| 339 | Ac-AALGVATAAQITAGIALHQSMLNSQAIDNLRASLE-NH2 | 336 |
| 340 | Ac-ALGVATAAQITAGIALHQSMLNSQAIDNLRASLET-NH2 | 337 |
| 341 | Ac-LGVATAAQITAGIALHQSMLNSQAIDNLRASLETT-NH2 | 338 |
| 342 | Ac-GVATAAQITAGIALHQSMLNSQAIDNLRASLETTN-NH2 | 339 |
| 343 | Ac-VATAAQITAGIALHQSMLNSQAIDNLRASLETTNQ-NH2 | 340 |
| 344 | Ac-ATAAQITAGIALHQSMLNSQAIDNLRASLETTNQA-NH2 | 341 |
| 345 | Ac-TAAQITAGIALHQSMLNSQAIDNLRASLETTNQAI-NH2 | 342 |
| 346 | Ac-AAQITAGIALHQSMLNSQAIDNLRASLETTNQAIE-NH2 | 343 |
| 347 | Ac-AQITAGIALHQSMLNSQAIDNLRASLETTNQAIEA-NH2 | 344 |

TABLE 1-continued

| T No. | Sequence | Seq. ID No. |
|---|---|---|
| 349 | Ac-QITAGIALHQSMLNSQAIDNLRASLETTNQAIEAI-NH2 | 345 |
| 350 | Ac-ITAGIALHQSMLNSQAIDNLRASLETTNQAIEAIR-NH2 | 346 |
| 351 | Ac-TAGIALHQSMLNSQAIDNLRASLETTNQAIEAIRQ-NH2 | 347 |
| 352 | Ac-AGIALHQSMLNSQAIDNLRASLETTNQAIEAIRQA-NH2 | 348 |
| 353 | Ac-GIALHQSMLNSQAIDNLRASLETTNQAIEAIRQAG-NH2 | 349 |
| 354 | Ac-IALHQSMLNSQAIDNLRASLETTNQAIEAIRQAGQ-NH2 | 350 |
| 355 | Ac-ALHQSMLNSQAIDNLRASLETTNQAIEAIRQAGQE-NH2 | 351 |
| 356 | Ac-LHQSMLNSQAIDNLRASLETTNQAIEAIRQAGQEM-NH2 | 352 |
| 357 | Ac-HQSMLNSQAIDNLRASLETTNQAIEAIRQAGQEMI-NH2 | 353 |
| 358 | Ac-QSMLNSQAIDNLRASLETTNQAIEAIRQAGQEMIL-NH2 | 354 |
| 359 | Ac-SMLNSQAIDNLRASLETTNQAIEAIRQAGQEMILA-NH2 | 355 |
| 360 | Ac-MLNSQAIDNLRASLETTNQAIEAIRQAGQEMILAV-NH2 | 356 |
| 361 | Ac-LNSQAIDNLRASLETTNQAIEAIRQAGQEMILAVQ-NH2 | 357 |
| 362 | Ac-NSQAIDNLRASLETTNQAIEAIRQAGQEMILAVQG-NH2 | 358 |
| 363 | Ac-SQAIDNLRASLETTNQAIEAIRQAGQEMILAVQGV-NH2 | 359 |
| 364 | Ac-QAIDNLRASLETTNQAIEAIRQAGQEMILAVQGVQ-NH2 | 360 |
| 365 | Ac-AIDNLRASLETTNQAIEAIRQAGQEMILAVQGVQD-NH2 | 361 |
| 366 | Ac-IDNLRASLETTNQAIEAIRQAGQEMILAVQGVQDY-NH2 | 362 |
| 367 | Ac-DNLRASLETTNQAIEAIRQAGQEMILAVQGVQDYI-NH2 | 363 |
| 368 | Ac-NLRASLETTNQAIEAIRQAGQEMILAVQGVQDYIN-NH2 | 364 |
| 369 | Ac-LRASLETTNQAIEAIRQAGQEMILAVQGVQDYINN-NH2 | 365 |
| 370 | Ac-RASLETTNQAIEAIRQAGQEMILAVQGVQDYINNE-NH2 | 366 |
| 371 | Ac-YTSVITIELSNIKENKUNGTDAVKLIKQELDKYK-NH2 | 1519 |
| 372 | Ac-TSVITIELSNIKENKUNGTDAVKLIKQELDKYKN-NH2 | 1520 |
| 373 | Ac-SVITIELSNIKENKUNGTDAVKLIKQELDKYKNA-NH2 | 1521 |
| 374 | Ac-SNIKENKUNGTDAKVKLIKQELDKYKNAVTELQLL-NH2 | 1522 |
| 375 | Ac-KENKUNGTDAKVKLIKQELDKYKNAVTELQLLMQS-NH2 | 1523 |
| 376 | Ac-CLELDKWASLWNWFC-NH2 | 372 |
| 377 | Ac-CLELDKWASLANWFC-NH2 | 373 |
| 378 | Ac-CLELDKWASLFNFFC-NH2 | 374 |
| 379 | Ac-YTSLIHSLIEESQNQQEKNEQELLELDKWASLFNFF-NH2 | 375 |
| 381 | Ac-RMKQLEDKVEELLSKNYHLENELELDKWASLWNWF-NH2 | 376 |
| 382 | Ac-KVEELLSKNYHLENELELDKWASLWNWF-NH2 | 377 |
| 383 | Ac-RMKQLEDKVEELLSKLEWIRRSNQKLDSI-NH2 | 378 |
| 384 | Ac-RMKQLEDKVEELLSKLAFIRKSDELLHNV-NH2 | 379 |
| 385 | Ac-ELEALRGELRALRGELELDKWASLWNWF-NH2 | 380 |
| 386 | Ac-LDPIDISIELNKAKSDLEESKEWIRRSNQKLDSI-NH2 | 381 |
| 387 | Ac-CNEQLSDSFPVEFFQV-NH2 | 382 |
| 388 | Ac-MAEDDPYLGRPEQMFHLDPSL-NH2 | 383 |
| 389 | Ac-EDFSSIADMDFSALLSQISS-NH2 | 384 |
| 390 | Ac-TWQEWERKVDFLEENITALLEEAQIQQEKNMYELQ-NH2 | 385 |
| 391 | Ac-WQEWERKVDFLEENITALLEEAQIQQEKNMYELQK-NH2 | 386 |
| 392 | Ac-QEWERKVDFLEENITALLEEAQIQQEKNMYELQKL-NH2 | 387 |
| 393 | Ac-EWERKVDFLEENITALLEEAQIQQEKNMYELQKLN-NH2 | 388 |
| 394 | Ac-WERKVDFLEENITALLEEAQIQQEKNMYELQKLNS-NH2 | 389 |
| 395 | Ac-ERKVDFLEENITALLEEAQIQQEKNMYELQKLNSW-NH2 | 390 |
| 396 | Ac-RKVDFLEENITALLEEAQIQQEKNMYELQKLNSWD-NH2 | 391 |
| 397 | Ac-KVDFLEENITALLEEAQIQQEKNMYELQKLNSWDV-NH2 | 392 |
| 398 | Ac-VDFLEENITALLEEAQIQQEKNMYELQKLNSWDVF-NH2 | 393 |
| 399 | Ac-DFLEENITALLEEAQIQQEKNMYELQKLNSWDVFG-NH2 | 394 |
| 400 | Ac-FLEENITALLEEAQIQQEKNMYELQKLNSWDVFGN-NH2 | 395 |
| 401 | Ac-LEENITALLEEAQIQQEKNMYELQKLNSWDVFGNW-NH2 | 396 |
| 402 | Ac-LEENITALLEEAQIQQEKNMYELQKLNSWDVFGNWF-NH2 | 397 |
| 403 | Ac-NEQSEEKENELYWAKEQLLDLLFNIFNQTVGAWIMQ-NH2 | 398 |
| 405 | Ac-QQQLLDVVKRQQELLRLTVWGTKNLQTRVTAIEKYLKD-NH2 | 400 |
| 406 | Ac-QQLLDVVKRQQELLRLTVWGTKNLQTRVTAIEKYLKDQ-NH2 | 401 |
| 407 | Ac-QQLLDVVKRQQELLRLTVWGPKNLQTRVTAIEKYLKDQ-NH2 | 402 |
| 408 | Ac-DERKQDKVLVVQQTGTLQLTLIQLEKTAKLQWVRLNRY-NH2 | 403 |
| 409 | Ac-QQQLLDVVKRQQELLPLTVWGTKNLQTRVTAIEKY-NH2 | 404 |
| 410 | Ac-QQLLDVVKRQQELLRLTVWGTKNLQTRVTAIEKYL-NH2 | 405 |
| 411 | Ac-QLLDVVKRQQELLRLTVWGTKNLQTRVTAIEKYLK-NH2 | 406 |
| 412 | Ac-LLDVVKRQQELLRLTVWGTKNLQTRVTAIEKYLKD-NH2 | 407 |
| 413 | Ac-LDVVKRQQELLRLTVWGTKNLQTRVTAIEKYLKDQ-NH2 | 408 |
| 414 | Ac-DVVKRQQELLRLTVWGTKNLQTRVTAIEKYLKDQA-NH2 | 409 |
| 415 | Ac-VVKRQQELLRLTVWGTKNLQTRVTAIEKYLKDQAQ-NH2 | 410 |
| 416 | Ac-VKRQQELLRLTVWGTKNLQTRVTAIEKYLKDQAQL-NH2 | 411 |
| 417 | Ac-KRQQELLRLTVWGTKNLQTRVTAIEKYLKDQAQLN-NH2 | 412 |
| 418 | Ac-RQQELLRLTVWGTKNLQTRVTAIEKYLKDQAQLNA-NH2 | 413 |
| 419 | Ac-QQELLRLTVWGTKNLQTRVTAIEKYLKDQAQLNAW-NH2 | 414 |
| 420 | Ac-QELLRLTVWGTKNLQTRVTAIEKYLKDQAQLNAWG-NH2 | 415 |
| 421 | Ac-ELLRLTVWGTKNLQTRVTAIEKYLKDQAQLNAWGC-NH2 | 416 |
| 422 | Ac-NNLLRAIEAQQHLLQLTVWGPKQLQARILAVERYLKDQ-NH2 | 417 |
| 423 | Ac-SELEIKRYKNRVASRKCRAKFKQLLQHYREVAAAK-NH2 | 418 |
| 424 | Ac-ELEIKRYKNRVASRKCRAKFKQLLQHYREVAAAKS-NH2 | 419 |
| 425 | Ac-LEIKRYKNRVASRKCRAKFKQLLQHYREVAAAKSS-NH2 | 420 |
| 426 | Ac-EIKRYKNRVASRKCRAKFKQLLQHYREVAAAKSSE-NH2 | 421 |

TABLE 1-continued

| T No. | Sequence | Seq. ID No. |
|---|---|---|
| 427 | Ac-IKRYKNRVASRKCRAKFKQLLQHYREVAAAKSSEN-NH2 | 422 |
| 428 | Ac-KRYKNRVASRKCRAKFKQLLQHYREVAAAKSSEND-NH2 | 423 |
| 429 | Ac-RYKNRVASRKCRAKFKQLLQHYREVAAAKSSENDR-NH2 | 424 |
| 430 | Ac-YKNRVASRKCRAKFKQLLQHYREVAAAKSSENDRL-NH2 | 425 |
| 431 | Ac-KNRVASRKCRAKFKQLLQHYREVAAAKSSENDRLR-NH2 | 426 |
| 432 | Ac-NRVASRKCRAKFKQLLQHYREVAAAKSSENDRLRL-NH2 | 427 |
| 433 | Ac-RVASRKCRAKFKQLLQHYREVAAAKSSENDRLRLL-NH2 | 428 |
| 434 | Ac-VASRKCRAKFKQLLQHYRLVAAAKSSENDRLRLLL-NH2 | 429 |
| 435 | Ac-ASRKCRAKFKQLLQHYREVAAAKSSENDRLRLLLK-NH2 | 430 |
| 436 | Ac-SRKCRAKFKQLLQHYREVAAAKSSENDRLRLLLKQ-NH2 | 431 |
| 437 | Ac-RKCRAKFKQLLQHYREVAAAKSSENDRLRLLLKQM-NH2 | 432 |
| 438 | Ac-KCRAKFKQLLQHYREVAAAKSSENDRLRLLLKQMC-NH2 | 433 |
| 439 | Ac-CRAKFKQLLQHYREVAAAKSSENDRLRLLLKQMCP-NH2 | 434 |
| 440 | Ac-RAKFKQLLQHYREVAAAKSSENDRLRLLLKQMCPS-NH2 | 435 |
| 441 | Ac-AKFKQLLQHYREVAAAKSSENDRLRLLLKQMCPSLNH2 | 436 |
| 442 | Ac-KFKQLLQHYREVAAAKSSENDRLRLLLKQMCPSLD-NH2 | 437 |
| 443 | Ac-FKQLLQHYREVAAAKSSENDRLRLLLKQMCPSLDV-NH2 | 438 |
| 444 | Ac-KQLLQHYREVAAAKSSENDRLRLLLKQMCPSLDVD-NH2 | 439 |
| 445 | Ac-QLLQHYREVAAAKSSENDRLRLLLKQMCPSLDVDS-NH2 | 440 |
| 446 | Ac-LLQHYREVAAAKSSENDRLRLLLKQMCPSLDVDSI-NH2 | 441 |
| 447 | Ac-LQHYREVAAAKSSENDRLRLLLKQMCPSLDVDSII-NH2 | 442 |
| 448 | Ac-QHYREVAAAKSSENDRLRLLLKQMCPSLDVDSIIP-NH2 | 443 |
| 449 | Ac-HYREVAAAKSSENDRLRLLLKQMCPSLDVDSIIPR-NH2 | 444 |
| 450 | Ac-YREVAAAKSSENDRLRLLLKQMCPSLDVDSIIPRT-NH2 | 445 |
| 451 | Ac-REVAAAKSSENDRLRLLLKQMCPSLDVDSIIPRTP-NH2 | 446 |
| 452 | Ac-EVAAAKSSENDRLRLLLKQMCPSLDVDSIIPRTPD-NH2 | 447 |
| 453 | Ac-VAAAKSSENDRLRLLLKQMCPSLDVDSIIPRTPDV-NH2 | 448 |
| 454 | Ac-AAAKSSENDRLRLLLKQMCPSLDVDSIIPRTPDVL-NH2 | 449 |
| 455 | Ac-AAKSSENDRLRLLLKQMCPSLDVDSIIPRTPDVLH-NH2 | 450 |
| 456 | Ac-AKSSENDRLRLLLKQMCPSLDVDSIIPRTPDVLHE-NH2 | 451 |
| 457 | Ac-KSSENDRLRLLLKQMCPSLDVDSIIPRTPDVLHED-NH2 | 452 |
| 458 | Ac-SSFNDRLRLLLKQMCPSLDVDSIIPRTPDVLHEDL-NH2 | 453 |
| 459 | Ac-SENDRLRLLLKQMCPSLDVDSIIPRTPDVLHEDLL-NH2 | 454 |
| 460 | Ac-ENDRLRLLLKQMCPSLDVDSIIPRTPDVLHEDLLN-NH2 | 455 |
| 461 | Ac-NDRLRLLLKQMCPSLDVDSIIPRTPDVLHEDLLNF-NH2 | 456 |
| 534 | Ac-PGYRWMCLRRFIIFLFILLLCLIFLLVLLDYQGML-NH2 | 458 |
| 535 | Ac-GYRWMCLRRFIIFLFILLLCLIFLLVLLDYQGMLP-NH2 | 459 |
| 536 | Ac-YRWMCLRRFIIFLFILLLCLIFLLVLLDYQGMLPV-NH2 | 460 |
| 537 | Ac-RWMCLRRFIIFLFILLLCLIFLLVLLDYQGMLPVC-NH2 | 461 |
| 538 | Ac-WMCLRRFIIFLFILLLCLIFLLVLLDYQGMLPVCP-NH2 | 462 |
| 539 | Ac-MCLRRFIIFLFILLLCLIFLLVLLDYQGMLPVCPL-NH2 | 463 |
| 540 | Ac-CLRRFIIFLFILLLCLIFLLVLLDYQGMLPVCPLI-NH2 | 464 |
| 541 | Ac-LRRFIIFLFILLLCLIFLLVLLDYQGMLPVCPLIP-NH2 | 465 |
| 542 | Ac-RRFIIFLFILLLCLIFLLVLLDYQGMLPVCPLIPG-NH2 | 466 |
| 543 | Ac-RFIIFLFILLLCLIFLLVLLDYQGMLPVCPLIPGS-NH2 | 467 |
| 544 | Ac-FIIFLFILLLCLIFLLVLLDYQGMLPVCPLIPGSS-NH2 | 468 |
| 545 | Ac-IIFLFILLLCLIFLLVLLDYQGMLPVCPLIPGSST-NH2 | 469 |
| 546 | Ac-IFLFILLLCLIFLLVLLDYQGMLPVCPLIPGSSTT-NH2 | 470 |
| 547 | Ac-FLFILLLCLIFLLVLLDYQGMLPVCPLIPGSSTTS-NH2 | 471 |
| 548 | Ac-LFILLLCLIFLLVLLDYQGMLPVCPLIPGSSTTST-NH2 | 472 |
| 549 | Ac-FILLLCLIFLLVLLDYQGMLPVCPLIPGSSTTSTG-NH2 | 473 |
| 550 | Ac-ILLLCLIFLLVLLDYQGMLPVCPLIPGSSTTSTGP-NH2 | 474 |
| 551 | Ac-LLLCLIFLLVLLDYQGMLPVCPLIPGSSTTSTGPC-NH2 | 475 |
| 552 | Ac-LLCLIFLLVLLDYQGMLPVCPLIPGSSTTSTGPCR-NH2 | 476 |
| 553 | Ac-LCLIFLLVLLDYQGMLPVCPLIPGSSTTSTGPCRT-NH2 | 477 |
| 554 | Ac-CLIFLLVLLDYQGMLPVCPLIPGSSTTSTGPCRTC-NH2 | 478 |
| 555 | Ac-LIFLLVLLDYQGMLPVCPLIPGSSTTSTGPCRTCM-NH2 | 479 |
| 556 | Ac-IFLLVLLDYQGMLPVCPLIPGSSTTSTGPCRTCMT-NH2 | 480 |
| 557 | Ac-FLLVLLDYQGMLPVCPLIPGSSTTSTGPCRTCMTT-NH2 | 481 |
| 558 | Ac-PPLVLQAGFFLLTRILTIPQSLDSWWTSLNFLGGT-NH2 | 1524 |
| 559 | Ac-LLVLQAGFFLLTRILTIPQSLDSWWTSLNFLGGTT-NH2 | 483 |
| 560 | Ac-LVLQAGFFLLTRILTIPQSLDSWWTSLNFLGGTTV-NH2 | 484 |
| 561 | Ac-VLQAGFFLLTRILTIPQSLDSWWTSLNFLGGTTVC-NH2 | 485 |
| 562 | Ac-LQAGFFLLTRILTIPQSLDSWWTSLNFLGGTTVCL-NH2 | 486 |
| 563 | Ac-QAGFFLLTRILTIPQSLDSWWTSLNFLGGTTVCLG-NH2 | 487 |
| 564 | Ac-AGFFLLTRILTIPQSLDSWWTSLNFLGGTTVCLGQ-NH2 | 488 |
| 565 | Ac-GFFLLTRILTIPQSLDSWWTSLNFLGGTTVCLGQN-NH2 | 489 |
| 566 | Ac-FFLLTRILTIPQSLDSWWTSLNFLGGTTVCLGQNS-NH2 | 490 |
| 567 | Ac-FLLTRILTIPQSLDSWWTSLNFLGGTTVCLGQNSQ-NH2 | 491 |
| 568 | Ac-LLTRILTIPQSLDSWWTSLNFLGGTTVCLGQNSQS-NH2 | 492 |
| 569 | Ac-LTRILTIPQSLDSWWTSLNFLGGTTVCLGQNSQSP-NH2 | 493 |
| 570 | Ac-FWNWLSAWKDLELKSLLEEVKDELQKMR-NH2 | 494 |
| 571 | Ac-NNLLRAIEAQQHLLQLTVW-NH2 | 495 |
| 572 | Ac-CGGNNLLRAIEAQQHLLQLTVWGIKQLQARILAVERYLKDQ-NH2 | 496 |
| 573 | Ac-YTSLIHSLIEESQNQQEKNEQELLELDKWASLWNWF-NH2 | 497 |
| 574 | C13H27CO-YTSLIHSLIEESQNQQEKNEQELLELDKWASLWNWF-NH2 | 498 |

TABLE 1-continued

| T No. | Sequence | Seq. ID No. |
|---|---|---|
| 575 | Ac-AVSKGYLSALRTGWYTSVITIELSNIKENKLNGTDA-NH2 | 1525 |
| 576 | Ac-SISNIETVIEFQQKNNRLLEITREFSVNAGVTTPVS-NH2 | 500 |
| 577 | Ac-DQQIKQYKRLLDRLIIPLYDGLRQKDVIVSNQESN-NH2 | 501 |
| 578 | Ac-YSELTNIFGDNIGSLQEKGIKLQGIASLYRTNITEI-NH2 | 502 |
| 579 | Ac-TSITLQVRLPLLTRLLNTQIYRVDSISYNIQNREWY-NH2 | 503 |
| 580 | Ac-VEIAEYRRLLRTVLEPIRDALNAMTQNIRPVQSVA-NH2 | 504 |
| 581 | Ac-SYFIVLSIAYPTLSEIKGVIVHRLEGVSYNIGSQEW-NH2 | 505 |
| 582 | Ac-LKEAIRDTNKAVQSVQSSIGNLIVAIKS-NH2 | 506 |
| 583 | NNLLRAIEAQQHLLQLTVWGIKQLQARILAVERYLKDQ-NH2 | 507 |
| 583 | NNLLRAIEAQQHLLQLTVWGIKQLQARILAVERYLKDQ-NH2 | 507 |
| 584 | QKQEPIDKELYPLTSL | 508 |
| 585 | YPKFVKQNTLKLAT | 509 |
| 586 | QYIKANQKFIGITE | 510 |
| 587 | NGQIGNDPNRDILY | 511 |
| 588 | AC-RPDVY-OH | 512 |
| 589 | CLELDKWASLWNWFC-(cyclic) | 513 |
| 590 | CLELDKWASLANWFC-(cyclic) | 514 |
| 591 | CLELDKWASLANFFC-(cyclic) | 515 |
| 594 | Ac-NNLLRAIEAQQQHLLQLTVWGIKQLQARILAVERYLKDQ-NH2 | 516 |
| 595 | Ac-CGGYTSLIHSLIEESQNQQEKNEQELLELDKWASLWNNWF-NH2 | 517 |
| 596 | Ac-PLLVLQAGFFLLTRILTIPQSLDSWWTSLNFLGGT-NH2 | 518 |
| 597 | Ac-LLVLQAGFFLLTRILTIPQSLDSWWTSLNFLGGTT-NH2 | 519 |
| 598 | Ac-LVLQAGFFLLTRILTIPQSLDSWWTSLNFLGGTTV-NH2 | 520 |
| 599 | Ac-VLQAGFFLLTRILTIPQSLDSWWTSLNFLGGTTVC-NH2 | 521 |
| 600 | Ac-LQAGFFLLTRILTIPQSLDSWWTSLNFLGGTTVCL-NH2 | 522 |
| 601 | Ac-QAGFFLLTRILTIPQSLDSWWTSLNFLGGTTVCLG-NH2 | 523 |
| 602 | Ac-AGFFLLTRILTIPQSLDSWWTSLNFLGGTTVCLGQ-NH2 | 524 |
| 603 | Ac-GFFLLTRILTIPQSLDSWWTSLNFLGGTTVCLGQN-NH2 | 525 |
| 604 | Ac-FFLLTRILTIPQSLDSWWTSLNFLGGTTVCLGQNS-NH2 | 526 |
| 605 | Ac-FLLTRILTIPQSLDSWWTSLNFLGGTTVCLGQNSQ-NH2 | 527 |
| 606 | Ac-LLTRILTIPQSLDSWWTSLNFLGGTTVCLGQNSQS-NH2 | 528 |
| 607 | Ac-LTRILTIPQSLDSWWTSLNFLGGTTVCLGQNSQSP-NH2 | 529 |
| 608 | Ac-LELDKWASLWNWA-NH2 | 530 |
| 609 | Ac-LELDKWASAWNWF-NH2 | 531 |
| 610 | Ac-LELDKAASLWNWF-NH2 | 532 |
| 611 | Ac-LKLDKWASLWNWF-NH2 | 533 |
| 612 | Ac-LELKKWASLWNWF-NH2 | 534 |
| 613 | Ac-DELLHNVNAGKST-NH2 | 535 |
| 614 | Ac-KSDELLHNVNAGKST-NH2 | 536 |
| 615 | Ac-IRKSDELLHNVNAGKST-NH2 | 537 |
| 616 | Ac-AFIRKSDELLHNVNAGKST-NH2 | 538 |
| 617 | Ac-FDASISQVNEKINQSLAFI-NH2 | 539 |
| 618 | Ac-YAADKESTQKAFDGITNKVNSVIEKMNTQFEAVGKE-NH2 | 540 |
| 619 | Ac-SVIEKMNTQFEAVGKEFGNLERRLENLNKRMEDGFL-NH2 | 541 |
| 620 | Ac-VWTYNAELLVLMENERTLDFHDSNVKNLYDKVRMQL-NH2 | 542 |
| 621 | Ac-EWDREINNYTSLIHSLIEESQNQQEKNEQEGGC-NH2 | 543 |
| 622 | Ac-INNYTSLIHSLIEESQNQQEKNEQELLELDKWASL-NH2 | 544 |
| 623 | Ac-INNYTSLIHSLIEESQNQQEKNEQELLE-NH2 | 545 |
| 624 | Ac-WMEWDREINNYTSLIHSLIEESQNQQEKNEQELLE-NH2 | 546 |
| 625 | Ac-MTWMEWDREINNYTSLIHSLIEESQNQQEKNEQELLELDKWASLWNWF-NH2 | 547 |
| 626 | Ac-IDISIELNKAKSDLEESKEWIKKSNQKLDSIGNWH-NH2 | 548 |
| 627 | Ac-NQQEKNEQELLELDKWASLWNWFNITNWLWYIKIFI-NH2 | 549 |
| 627 | Ac-NQQEKNEQELLELDKWASLWNWFNITNWLWYIKIFI-NH2 | 549 |
| 628 | Ac-QNQQEKNEQELLELDKWASLWNWFNITNWLWYIKIF-NH2 | 550 |
| 629 | Ac-SQNQQEKNEQELLELDKWASLWNWFNITNWLWYIKI-NH2 | 551 |
| 630 | Ac-ESQNQQEKNEQELLELDKWASLWNWFNITNWLWYIK-NH2 | 552 |
| 631 | Ac-EESQNQQEKNEQELLELDKWASLWNWFNITNWLWYI-NH2 | 553 |
| 632 | Ac-IEESQNQQEKNEQELLELDKWASLWNWFNITNWLWY-NH2 | 554 |
| 633 | Ac-LIEESQNQQEKNEQELLELDKWASLWNWFNITNWLW-NH2 | 555 |
| 634 | Ac-SLIEESQNQQEKNEQELLELDKWASLWNWFNITNWL-NH2 | 556 |
| 635 | Ac-HSLIEESQNQQEKNEQELLELDKWASLWNWFNITNW-NH2 | 557 |
| 636 | Ac-IHSLIEESQNQQEKNEQELLELDKWASLWNWFNITN-NH2 | 558 |
| 637 | Ac-LIHSLIEESQNQQEKNEQELLELDKWASLWNWFNIT-NH2 | 559 |
| 638 | Ac-SLIHSLIEESQNQQEKNEQELLELDKWASLWNWFNI-NH2 | 560 |
| 639 | Ac-TSLIHSLIEESQNQQEKNEQELLELDKWASLWNWFN-NH2 | 561 |
| 640 | Ac-NYTSLIHSLIEESQNQQEKNEQELLELDKWASLWNW-NH2 | 562 |
| 641 | Ac-NNYTSLIHSLIEESQNQQEKNEQELLELDKWASLWN-NH2 | 563 |
| 642 | Ac-INNYTSLIHSLIEESQNQQEKNEQELLELDKWASLW-NH2 | 564 |
| 643 | Ac-EINNYTSLIHSLIEESQNQQEKNEQELLELDKWASL-NH2 | 565 |
| 644 | Ac-REINNYTSLIHSLIEESQNQQEKNEQELLELDKWAS-NH2 | 566 |
| 645 | Ac-DREINNYTSLIHSLIEESQNQQEKNEQELLELDKWA-NH2 | 567 |
| 646 | Ac-WDREINNYTSLIHSLIEESQNQQEKNEQELLELDKW-NH2 | 568 |
| 647 | Ac-EWDREINNYTSLIHSLIEESQNQQEKNEQELLELDK-NH2 | 569 |
| 648 | Ac-MEWDREINNYTSLIHSLIEESQNQQEKNEQELLELD-NH2 | 570 |
| 649 | Ac-WMEWDREINNYTSLIHSLIEESQNQQEKNEQELLEL-NH2 | 572 |
| 650 | Ac-TWMEWDREINNYTSLIHSLIEESQNQQEKNEQELLE-NH2 | 573 |

TABLE 1-continued

| T No. | Sequence | Seq. ID No. |
|---|---|---|
| 651 | Ac-MTWMEWDREINNYTSLIHSLIEESQNQQEKNEQELL-NH2 | 574 |
| 652 | Ac-NMTWMEWDREINNYTSLIHSLIEESQNQQEKNEQEL-NH2 | 575 |
| 653 | Ac-NNMTWMEWDREINNYTSLIHSLIEESQNQQEKNEQE-NH2 | 576 |
| 654 | Ac-WNNMTWMEWDREINNYTSLIHSLIEESQNQQEKNEQ-NH2 | 577 |
| 655 | Ac-IWNNMTWMEWDREINNYTSLIHSLIEESQNQQEKNE-NH2 | 578 |
| 656 | Ac-QIWNNMTWMEWDREINNYTSLIHSLIEESQNQQEKN-NH2 | 579 |
| 657 | Ac-EQIWNNMTWMEWDRENNYTSLIHSLIEESQNQQEK-NH2 | 580 |
| 658 | Ac-LEQIWNNMTWMEWDREINNYTSLIHSLIEESQNQQE-NH2 | 581 |
| 659 | Ac-SLEQIWNNMTWMEWDREINNYTSLIHSLIEESQNQQ-NH2 | 582 |
| 660 | Ac-KSLEQIWNNMTWMEWDREINNYTSLIHSLIEESQNQ-NH2 | 583 |
| 661 | Ac-NKSLEQIWNNMTWMEWDREINNYTSLIHSLIEESQN-NH2 | 584 |
| 662 | Ac-SLAFIRKSDELLHNVNAGKST-NH2 | 585 |
| 663 | Ac-FDASISQVNEKINQSLAFIRK-NH2 | 586 |
| 664 | Ac-YTSLIHSLIEESQQQQEKQEQELLELDKWASLWNWF-NH2 | 587 |
| 665 | Ac-FDASISQVNEKINQSLAFIRKSDELLHNVNAGK-NH2 | 588 |
| 666 | Ac-FDASISQVNEKINQSLAFIRKSDELLHNVNA-NH2 | 589 |
| 667 | Ac-FDASISQVNEKINQSLAFIRKSDELLHNV-NH2 | 590 |
| 668 | Ac-FDASISQVNEKINQSLAFIRKSDELLH-NH2 | 591 |
| 669 | Ac-FDASISQVNEKINQSLAFIRKSDEL-NH2 | 592 |
| 670 | Ac-FDASISQVNEKINQSLAFIRKSD-NH2 | 593 |
| 671 | Ac-ASISQVNEKINQSLAFIRKSDELLHNVNAGKST-NH2 | 594 |
| 672 | Ac-ISQVNEKINQSLAFIRKSDELLHNVNAGKST-NH2 | 595 |
| 673 | Ac-QVNEKINQSLAFIRKSDELLHNVNAGKST-NH2 | 596 |
| 674 | Ac-NEKINQSLAFIRKSDELLHNVNAGKST-NH2 | 597 |
| 675 | Ac-KINQSLAFIRKSDELLHNVNAGKST-NH2 | 598 |
| 676 | Ac-NQSLAFIRKSDELLHNVNAGKST-NH2 | 599 |
| 677 | Ac-FWNWLSAWKDLELYPGSLELDKWASLWNWF-NH2 | 600 |
| 678 | Ac-CGGNNLLRAIEAQQHLLQLTVWGIKQLQARILAVERYLKDQ-NH2 | 601 |
| 679 | Ac-CGGYTSLIHSLIEESQNQQEKNEQELLELDKWASLWNWF-NH2 | 602 |
| 680 | YTSLIHSLIEESQNQQEKNEQELLELDKWASLWNWF | 603 |
| 681 | NNLLRAIEAQQHLLQLTVWGIKQLQARILAVERYLKDQ | 604 |
| 682 | Ac-EKNMYELQKLNSWDVFTNWLDFTSWVRYIQYIQYGV-NH2 | 605 |
| 683 | Ac-QEKNMYELQKLNSWDVFTNWLDFTSWVRYIQYIQYG-NH2 | 606 |
| 684 | Ac-QQEKNMYELQKLNSWDVFTNWLDFTSWVRYIQYIQY-NH2 | 607 |
| 685 | Ac-IQQEKNMYELQKLNSWDVFTNWLDFTSWVRYIQYIQ-NH2 | 608 |
| 686 | Ac-QIQQEKNMYELQKLNSWDVFTNWLDFTSWVRYIQYI-NH2 | 609 |
| 687 | Ac-AQIQQEKNMYELQKLNSWDVFTNWLDFTSWVRYIQY-NH2 | 610 |
| 688 | Ac-QAQIQQEKNMYELQKLNSWDVFTNWLDFTSWVRYIQ-NH2 | 611 |
| 689 | Ac-EQAQIQQEKNMYELQKLNSWDVFTNWLDFTSWVRYI-NH2 | 612 |
| 690 | Ac-LEQAQIQQEKNMYELQKLNSWDVFTNWLDFTSWVRY-NH2 | 613 |
| 691 | Ac-SLEQAQIQQEKNMYELQKLNSWDVFTNWLDFTSWVR-NH2 | 614 |
| 692 | Ac-QSLEQAQIQQEKNMYELQKLNSWDVFTNWLDFTSWV-NH2 | 615 |
| 693 | Ac-SQSLEQAQIQQEKNMYELQKLNSWDVFTNWLDFTSW-NH2 | 616 |
| 694 | Ac-ISQSLEQAQIQQEKNMYELQKLNSWDVFTNWLDFTS-NH2 | 617 |
| 695 | Ac-NISQSLEQAQIQQEKNMYELQKLNSWDVFTNWLDFT-NH2 | 618 |
| 696 | Ac-ANISQSLEQAQIQQEKNMYELQKLNSWDVFTNWLDF-NH2 | 619 |
| 697 | Ac-EANISQSLEQAQIQQEKNMYELQKLNSWDVFTNWLD-NH2 | 620 |
| 699 | Ac-YLEANISQSLEQAQIQQEKNMYELQKLNSWDVFTNW-NH2 | 622 |
| 700 | Ac-YTSLIHSLIEESQNQQEKNEQEL-NH2 | 623 |
| 701 | Ac-YTSLIHSLIEESQNLQEKNEQELLELDKWASLWNWF-NH2 | 624 |
| 702 | Ac-YTSLIHSLIEESQNQQEKLEQELLELDKWASLWNWF-NH2 | 625 |
| 703 | Ac-YTSLIHSLIEESQNQQEKNEQELLEFDKWASLWNWF-NH2 | 626 |
| 704 | Ac-YTSLIHSLIEESQNQQEKNEQELLELDKPASLWNWF-NH2 | 627 |
| 705 | Ac-YTSLIHSLIEESQNQQEKNEQELLELDKWASPWNWF-NH2 | 628 |
| 706 | Ac-YTSLIHSLIEESQNQQEKNEQELLELDKWASLWNSF-NH2 | 629 |
| 707 | Biotin NH(CH2)4CO-YTSLIHSLIEESQNQQEKNEQELLELDKWASLWNWF-NH2 | 705 |
| 708 | Biotin NH(CH2)6CO-YTSLIHSLIEESQNQQEKNEQELLELDKWASLWNWF-NH2 | 630 |
| 709 | FMOC-YTSLIHSLIEESQNQQEKNEQELLELDKWASLWNWF | 497 |
| 710 | FMOC-NNLLRAIEAQQHLLQLTVWGIKQLQARILAVERYLKDQ | 16 |
| 711 | Ac-EWDREINNYTSLIHSLIEESQNQQEKNEQE-NH2 | 634 |
| 712 | Ac-LIEESQNQQEKNEQELLELDKWASLWNWF-NH2 | 635 |
| 713 | Ac-FWNWLSAWKDLELGGPGSGPGGLELDKWASLWNWF-NH2 | 636 |
| 714 | Ac-LIHSLIEESQNQQEKNEQELLELDKWASL-NH2 | 637 |
| 715 | Ac-TSLIHSLIEESQNQQEKNEQELLELDKWASLWNWF-NH2 | 638 |
| 716 | Ac-LIHSLIEESQNQQEKNEQELLELDKWASLWNWF-NH2 | 639 |
| 718 | FMOC-GGGGGYTSLIHSLIEESQNQQEKNEQELLELDKWASLWNWF | 640 |
| 719 | Ac-HSLIEESQNQQEKNEQELLELDKWASLWNWF-NH2 | 641 |
| 720 | Ac-YTSLIYSLIEESQNQQEKNEQELLELDKWASLWNWF-NH2 | 642 |
| 721 | Ac-YTSLIHSLIEKSQNQQEKNEQELLELDKWASLWNWF-NH2 | 643 |
| 722 | Ac-YTSLIHSSIEESQNQQEKNEQELLELDKWASLWNWF-NH2 | 644 |
| 723 | Ac-LEANISQLLEQAQIQQEKNMYELQKLNSWDVFTNWL-NH2 | 645 |
| 724 | Ac-SLEECDSELEIKRYKNRVASRKCRAKFKQLLQHYR-NH2 | 646 |
| 725 | Ac-LEECDSELEIKRYKNRVASRKCRAKFKQLLQHYRE-NH2 | 647 |
| 726 | Ac-EECDSELEIKRYKNRVASRKCRAKFKQLLQHYREV-NH2 | 648 |
| 727 | Ac-ECDSELEIKRYKNRVASRKCRAKFKQLLQHYREVA-NH2 | 649 |
| 728 | Ac-CDSELEIKRYKNRVASRKCRAKFKQLLQHYREVAA-NH2 | 650 |

TABLE 1-continued

| T No. | Sequence | Seq. ID No. |
|---|---|---|
| 729 | Ac-DSELEIKRYKNRVASRKCRAKFKQLLQHYREVAAA-NH2 | 651 |
| 730 | Desaminotyrosine-FDASISQVNEKINQSLAFIRKSDELLHNVNAGKST-NH2 | 679 |
| 731 | WASLWNW-NH2 | 653 |
| 732 | Ac-EAQQHLLQLTVWGIKQLQARILAVERYLKDQQLLGIWG-NH2 | 654 |
| 733 | Ac-IEAQQHLLQLTVWGIKQLQARILAVERYLKDQQLLGIW-NH2 | 655 |
| 734 | Ac-AIEAQQHLLQLTVWGIKQLQARILAVERYLKDQQLLGI-NH2 | 656 |
| 735 | Ac-RAIEAQQHLLQLTVWGIKQLQARILAVERYLKDQQLLG-NH2 | 657 |
| 736 | Ac-LRAIEAQQHLLQLTVWGIKQLQARILAVERYLKDQQLL-NH2 | 658 |
| 737 | Ac-LLRAIEAQQHLLQLTVWGIKQLQARILAVERYLKDQQL-NH2 | 659 |
| 738 | Ac-NLLRAIEAQQHLLQLTVWGIKQLQARILAVERYLKDQQ-NH2 | 660 |
| 739 | Ac-QNNLLRAIEAQQHLLQLTVWGIKQLQARILAVERYLKD-NH2 | 661 |
| 740 | Ac-QQNNLLRAIEAQQHLLQLTVWGIKQLQARILAVERYLK-NH2 | 662 |
| 741 | Ac-QQQNNLLRAIEAQQHLLQLTVWGIKQLQARILAVERYL-NH2 | 663 |
| 742 | Ac-VQQQNNLLRAIEAQQHLLQLTVWGIKQLQARILAVERY-NH2 | 664 |
| 743 | Ac-IVQQQNNLLRAIEAQQHLLQLTVWGIKQLQARILAVER-NH2 | 665 |
| 744 | Ac-GIVQQQNNLLRAIEAQQHLLQLTVWGIKQLQARILAVE-NH2 | 666 |
| 745 | Ac-SGIVQQQNNLLRAIEAQQHLLQLTVWGIKQLQARILAV-NH2 | 667 |
| 758 | Ac-RSMTLTVQARQLLSGIVQQQNNLLRAIEAQQHLLQLTV-NH2 | 668 |
| 760 | Ac-GARSMTLTVQARQLLSGIVQQQNNLLRAIEAQQHLLQL-NH2 | 669 |
| 764 | Ac-GSTMGARSMTLTVQARQLLSGIVQQQNNLLRAIEAQQH-NH2 | 670 |
| 765 | Ac-GSTMGARSMTLTVQARQLLSGIVQQQNNLLRAIEAQQH-NH2 | 671 |
| 766 | Ac-EGSTMGARSMTLTVQARQLLSGIVQQQNNLLRAIEAQQ-NH2 | 672 |
| 767 | Ac-RAKFKQLLQHYREVAAAKSSENDRLRLL-NH2 | 673 |
| 768 | Ac-AKFKQLLQHYREVAAAKSSENDRLRLLL-NH2 | 674 |
| 769 | Ac-KFKQLLQRYREVAAAKSSENDRLRLLLK-NH2 | 675 |
| 770 | Ac-FKQLLQHYREVAAAKSSENDRLRLLLKQ-NH2 | 676 |
| 771 | Ac-RAKFKQELQHYREVAAAKSSENDRLRLLLKQMCPS-NH2 | 677 |
| 772 | DKWASLWNWF-NH2 | 678 |
| 773 | Biotin-FDASISQVNEKINQSLAFIRKSDELLHNVNAGKST-NH2 | 679 |
| 774 | Ac-YDASISQVNEKINQSLAFIRKSDELLHNVNAGKST-NH2 | 680 |
| 775 | Ac-YDASISQVNEKINQSLAYIRKSDELLHNVNAGKST-NH2 | 681 |
| 776 | Ac-FDASISQVNEKINQSLAYIRKSDELLHNVNAGKST-NH2 | 682 |
| 777 | Ac-FDASISQVQEKIQQSLAFIRKSDELLHQVQAGKST-NH2 | 683 |
| 778 | Ac-FDASISQVNEKINQALAFIRKADELLHNVNAGKST-NH2 | 684 |
| 779 | Ac-FDASISQVNEKINQALAFIRKSDELLHNVNAGKST-NH2 | 685 |
| 780 | Ac-FDASISQVNEKINQSLAFIRKADELLHNVNAGKST-NH2 | 686 |
| 781 | Ac-YDASISQVQEEIQQALAFIRKADELLEQVQAGKST-NH2 | 687 |
| 782 | Ac-FDASISQVNEKINQSLAFIRKSDELLENVNAGKST-NH2 | 688 |
| 783 | Ac-FDASISQVNEEINQSLAFIRKSDELLHNVNAGKST-NH2 | 689 |
| 784 | Ac-VFPSDEFDASISQVNEKINQSLAFIRKSDELLENV-NH2 | 690 |
| 785 | Ac-VFPSDEFDASISQVNEEINQSLAFIRKSDELLENV-NH2 | 691 |
| 786 | Ac-VYPSDEYDASISQVNEEINQALAYIRKADELLENV-NH2 | 692 |
| 787 | Ac-VFPSDEFDASISQVNEEINQSLAFIRKSDELLHNV-NH2 | 693 |
| 788 | Ac-SNKSLEQIWNNMTWMEWDREINNYTSLIHSLIEESQ-NH2 | 694 |
| 789 | Ac-WSNKSLEQIWNNMTWMEWDREINNYTSLIHSLIEES-NH2 | 695 |
| 790 | Ac-SWSNKSLEQIWNNMTWMEWDREINNYTSLIHSLIEE-NH2 | 696 |
| 791 | Ac-ASWSNKSLEQIWNNMTWMEWDREINNYTSLIHSLIE-NH2 | 697 |
| 792 | Ac-NASWSNKSLEQIWNNMTWMEWDREINNYTSLIHSLI-NH2 | 698 |
| 793 | Ac-WNASWSNKSLEQIWNNMTWMEWDREINNYTSLIHSL-NH2 | 699 |
| 793 | Ac-WNASWSNKSLEQIWNNMTWMEWDREINNYTSLIHSL-NH2 | 699 |
| 794 | Ac-PWNASWSNKSLEQIWNNMTWMEWDREINNYTSLIHS-NH2 | 700 |
| 795 | Ac-VPWNASWSNKSLEQIWNNMTWMEWDREINNYTSLIH-NH2 | 701 |
| 796 | Ac-AVPWNASWSNKSLEQIWNNMTWMEWDREINNYTSLI-NH2 | 702 |
| 797 | Ac-TAVPWNASWSNKSLEQIWNNMTWMEWDREINNYTSL-NH2 | 703 |
| 798 | Ac-TTAVPWNASWSNKSLEQIWNNMTWMEWDREINNYTS-NH2 | 704 |
| 800 | Ac-AAASDEFDASISQVNEKINQSLAFIRKSDELLHNV-NH2 | 706 |
| 801 | Ac-VFFAAAFDASISQVNEKINQSLAFIRKSDELLHNV-NH2 | 707 |
| 802 | Ac-VFPSDEAAASISQVNEKINQSLAFIRKSDELLHNV-NH2 | 708 |
| 803 | Ac-VFPSDEFDAAAAQVNEKINQSLAFIRKSDELLHNV-NH2 | 709 |
| 804 | Ac-VFPSDEFDASISAAAEKINQSLAFIRKSDELLHNV-NH2 | 710 |
| 805 | Ac-VFPSDEFDASISQVNAAANQSLAFIRKSDELLHNV-NH2 | 711 |
| 806 | Ac-VFPSDEFDASISQVNEKIAAALAFIRKSDELLHNV-NH2 | 712 |
| 807 | Ac-VFPSDEFDASISQVNEKINQSAAAIRKSDELLHNV-NH2 | 713 |
| 808 | Ac-VFPSDEFDASISQVNEKINQSLAFAAASDELLHNV-NH2 | 714 |
| 809 | Ac-VFPSDEFDASISQVNEKINQSLAFIRKAAALLHNV-NH2 | 715 |
| 810 | Ac-VFPSDEFDASISQVNEKINQSLAFIRKSDEAAANV-NH2 | 716 |
| 811 | Ac-VFPSDEFDASISQVNEKINQSLAFIRKSDELLAAA-NH2 | 717 |
| 812 | Ac-VYPSDEFDASISQVNEKINQSLAFIRKSDELLHNV-NH2 | 718 |
| 813 | Ac-AAAAIHSLIEESQNQQEKNEQELLELDKWASLWNWF-NH2 | 719 |
| 814 | Ac-YTSLIRSLIEESQQQQEKNEQELLELDKWASLWNWF-NH2 | 720 |
| 815 | Ac-YTSLIHSLIEESQNQQEKQEQELLELDKWASLWNWF-NH2 | 721 |
| 816 | Ac-QIWNNMTWMEWDREINNYTSLIHSLIEESQNQQEKQ-NH2 | 722 |
| 817 | Ac-QIWNNMTWMEWDREINNYTSLIHSLIEESQQQEKN-NH2 | 723 |
| 818 | Ac-QIWNNMTWMEWDREINNYTSLIHSLIEESQQQQEKQ-NH2 | 724 |
| 819 | Ac-NKSLEQIWNNMTWMEWDREINNYTSLIHSLIEESQQ-NH2 | 725 |
| 820 | Ac-FDASISQVNEKINQSLAFIEESDELLHNVNAGKST-NH2 | 726 |

TABLE 1-continued

| T No. | Sequence | Seq. ID No. |
|---|---|---|
| 821 | Ac-ACIRKSDELCL-NH2 | 727 |
| 823 | Ac-YTSLIHSLIEESQNQQEKDEQELLELDKWASLWNWF-NH2 | 728 |
| 824 | Ac-YTSLIHSLIEESQDQQEKNEQELLELDKWASLWNWF-NH2 | 729 |
| 825 | Ac-YTSLIHSLIEESQDQQEKDEQELLELDKWASLWNWF-NH2 | 730 |
| 826 | Ac-YTSLIHSLIEESQNQQEKNEQELLELDKWASLWDWF-NH2 | 731 |
| 841 | Ac-LEANITQSLEQAQIQQEKNMYELQKLNSWDVFTNWL-NH2 | 732 |
| 842 | Ac-LEANISASLEQAQIQQEKNMYELQKLNSWDVFTNWL-NH2 | 733 |
| 843 | Ac-LEANISALLEQAQIQQEKNMYELQKLNSWDVFTNWL-NH2 | 734 |
| 844 | Ac-LEANITALLEQAQIQQEKNMYELQKLNSWDVFTNWL-NH2 | 735 |
| 845 | Ac-LEANITASLEQAQIQQEKNMYELQKLNSWDVFTNWL-NH2 | 736 |
| 845 | Ac-LEANITASLEQAQIQQEKNMYELQKLNSWDVFTNWL-NH2 | 736 |
| 846 | Ac-RAKFKQLLQHYREVAAAKSSENDRLRLLLKQMUPS-NH2 | 1526 |
| 847 | Ac-Abu-DDE-Abu-MNSVKNGTYDYPKYEEESKLNRNEIKGVKL-NH2 | 1527 |
| 856 | Ac-WQEWEQKVRYLEANISQSLEQAQIQQEKNMYELQKL-NH2 | 739 |
| 860 | Ac-DEYDASISQVNEKINQSLAFIRKSDELLHNVNAGK-NH2 | 740 |
| 861 | Ac-YTSLIHSLIEESQNQQEKNEQELLELDKWASLWN-NH2 | 741 |
| 862 | Ac-YTSLIHSLIEESQNQQEKNEQELLELDKWASLW-NH2 | 742 |
| 863 | Ac-YTSLIHSLIEESQNQQEKNEQELLELDKWASL-NH2 | 743 |
| 864 | Ac-YTSLIHSLIEESQNQQEKNEQELLELDKWAS-NH2 | 744 |
| 865 | Ac-QARQLLSGIVQQQNNLLRAIEAQQHLLQLTVWGIKQLQARILAVERYLKDQ-NH2 | 745 |
| 866 | Ac-DREINNYTSLIHSLIEESQNQQEKNEQELLELDKWASLWNWF-NH2 | 746 |
| 867 | Ac-NNMTWMEWDREINNYTSLIHSLIEESQNQQEKNEQELLELDK-NH2 | 747 |
| 868 | Ac-YTSLIHSLIEESQNQQEKNEQELLELDKWASLWAAA-NH2 | 748 |
| 869 | Ac-YTSLIHSLIEESQNQQEKNEQELLELDKWAAAANWF-NH2 | 749 |
| 870 | Ac-YTSLIHSLIEESQNQQEKNEQELLELDAAASLWNWF-NH2 | 750 |
| 871 | Ac-YTSLIHSLIEESQNQQEKNEQELLAAAKWASLWNWF-NH2 | 751 |
| 872 | Ac-YTSLIHSLIEESQNQQEKNEQAAAELDKWASLWNWF-NH2 | 752 |
| 873 | Ac-YTSLIHSLIEESQNQQEKAAAELLELDKWASLWNWF-NH2 | 753 |
| 874 | Ac-YTSLIHSLIEESQNQAAANEQELLELDKWASLWNWF-NH2 | 754 |
| 875 | Ac-YTSLIHSLIEESAAAQEKNEQELLELDKWASLWNWF-NH2 | 755 |
| 876 | Ac-YTSLIHSLIAAAQNQQEKNEQELLELDKWASLWNWF-NH2 | 756 |
| 877 | Ac-YTSLIHAAAEESQNQQEKNEQELLELDKWASLWNWF-NH2 | 757 |
| 878 | Ac-YTSAAASLIEESQNQQEKNEQELLELDKWASLWNWF-NH2 | 758 |
| 879 | Ac-EIWNNMTWMEWDRENEKINQSLAFIRKSDELLHNV-NH2 | 759 |
| 880 | Ac-YISEVNEEINQSLAFIRKADELLENVDKWASLWNWF-NH2 | 760 |
| 881 | Ac-TSVITIELSNIKENKANGTDAKVKLIKQELDKYKN-NH2 | 761 |
| 882 | YTSLIHSLIEESQNQQEKNEQELLELDKWASLWNWFMG-NH2 | 762 |
| 883 | Ac-NEKINQSLAFIRKSDELLHNV-NH2 | 763 |
| 884 | Biotin-YDPLVFPSDEFDASISQVNEKINQSLAFIRKSDFL-NH2 | 764 |
| 885 | Biotin-PLVFPSDEFDASISQVNEKINQSLAFIRKSDELLH-NH2 | 765 |
| 886 | Biotin-VFPSDEFDASISQVNEKINQSLAFIRKSDELLHNV-NH2 | 766 |
| 887 | Biotin-DEFDASISQVNEKINQSLAFIRKSDELLHNVNAGK-NH2 | 767 |
| 888 | Biotin-VYPSDEFDASISQVNEKINQSLAFIRKSDELLHNV-NH2 | 768 |
| 889 | Biotin-VYPSDEYDASISQVNEEINQALAYIRKADELLENV-NH2 | 769 |
| 890 | Ac-VYPSDEFDASISQVQEEIQQALAFIRKADELLEQV-NH2 | 770 |
| 891 | Ac-NYTSLIHSLIEESQNQQEKNEQELLELDKWASLWNWF-NH2 | 771 |
| 892 | Ac-NNYTSLIHSLIEESQNQQEKNEQELLELDKWASLWNWF-NH2 | 772 |
| 893 | Ac-INNYTSLIHSLIEESQNQQEKNEQELLELDKWASLWNWF-NH2 | 773 |
| 894 | Ac-EINNYTSLIHSLIEESQNQQEKNEQELLELDKWASLWNWF-NH2 | 774 |
| 895 | Ac-YTSLIHSLIEESQNQQEKNEQELLELDKWASLWNWFN-NH2 | 775 |
| 896 | Ac-YTSLIHSLIEESQNQQEKNEQELLELDKWASLWNWFNI-NH2 | 776 |
| 897 | Ac-YTSLIHSLIEESQNQQEKNEQELLELDKWASLWNWFNIT-NH2 | 777 |
| 898 | Ac-YTSLIHSLIEESQNQQEKNEQELLELDKWASLWNWFNITN-NH2 | 778 |
| 899 | Ac-YDPLVFPSDEFDASISQVNEKINQSLAFIRKSDELLHNVNAGK-NH2 | 779 |
| 900 | Ac-NYTSLIHSLIEESQNQQEKNEQELLELDKWASLWNWFN-NH2 | 780 |
| 901 | Ac-NNYTSLIHSLIEESQNQQEKNEQELLELDKWASLWNWFNI-NH2 | 781 |
| 905 | Ac-KCRAKFKQLLQHYREVAAAKSSENDRLRLLLKQMCPSLDVDSIIPRTPD-NH2 | 782 |
| 906 | Ac-RAKFKQLLQHYREVAAAKSSENDRLRLLLKQMCPSLDVDSIIPRTPD-NH2 | 783 |
| 907 | Ac-VYPSDEYDASISQVNEEINQALAYIAAADELLENV-NH2 | 784 |
| 909 | Ac-YDASISQVNEEINQALAYIRKADELL-NH2 | 785 |
| 910 | Ac-M-Nle-WMEWDREINNYTSLIHSLIEESQNQQEKNEQELLEL-NH2 | 1528 |
| 911 | Ac-KNGTYDYPKYEEESKLNRNEIKGVKLSSMGVYQI-NH2 | 787 |
| 912 | Ac-VTEKIQMASDNINDLIQSGVNTRLLTIQSHVQNYI-NH2 | 788 |
| 913 | QNQQEKNEQELLELDKWASLWNWF-NH2 | 789 |
| 914 | Ac-QNQQEKNEQELLELDKWASLWNWF-NH2 | 790 |
| 915 | LWNWF-NH2 | 791 |
| 916 | ELLELDKWASLWNWF-NH2 | 792 |
| 917 | EKNEQELLELDKWASLWNWF-NH2 | 793 |
| 918 | SLIEESQNQQEKNEQELLELDKWASLWNWF-NH2 | 794 |
| 919 | Ac-YTSLIHSLIEESQNQQEKNEQELLELDKWASLWNW | 795 |
| 920 | Ac-YTSLIHSLIEESQNQQEKNEQELLELDKWASLWN | 796 |
| 921 | Ac-YTSLIHSLIEESQNQQEKNEQELLELDKWASLW | 797 |
| 922 | Ac-YTSLIHSLIEESQNQQEKNEQELLELDKWASL | 798 |
| 923 | TSLIHSLIEESQNQQEKNEQELLELDKWASLWNWF-NH2 | 799 |
| 924 | SLIHSLIEESQNQQEKNEQELLELDKWASLWNWF-NH2 | 800 |
| 925 | LIHSLIEESQNQQEKNEQELLELDKWASLWNWF-NH2 | 801 |

TABLE 1-continued

| T No. | Sequence | Seq. ID No. |
|---|---|---|
| 926 | IHSLIEESQNQQEKNEQELLELDKWASLWNWF-NH2 | 802 |
| 940 | Ac-AAVALLPAVLLALLAPSELEIKRYKNRVASRKCRAKFKQLLQHYREVAAAK-NH2 | 803 |
| 941 | Ac-AAVALLPAVLLALLAPCRAKFKQLLQHYREVAAAKSSENDRLRLLLKQMCP-NH2 | 804 |
| 942 | Ac-YTSLIHSLIEESQNQQEKNNNIERDWEMWTMNNWIQ-NH2 | 805 |
| 944 | VYPSDEYDASISQVNEEINQALAYIRKADELLENV-NH2 | 806 |
| 945 | Ac-LMQLARQLMQLARQMKQLADSLMQLARQVSRLESA-NH2 | 807 |
| 946 | Ac-WMEWDREINNYTSLIHSLIEESQNQQEKNEQELL-NH2 | 808 |
| 947 | Ac-MEWDREINNYTSLIHSLIEESQNQQEKNEQELLEL-NH2 | 809 |
| 948 | Ac-EWDREINNYTSLIHSLIEESQNQQEKNEQELLEL-NH2 | 810 |
| 949 | Ac-MEWDREINNYTSLIHSLIEESQNQQEKNEQELLE-NH2 | 811 |
| 950 | Biotin-W-Nle-EWDREINNYTSLIHSLIEESQNQQEKNEQELLEL-NH2 | 1529 |
| 951 | Ac-YLEYDREINNYTSLIHSLIEESQNQQEKNEQELLEL-NH2 | 813 |
| 952 | Ac-IKQFINMWQEVGKAMYA-NH2 | 814 |
| 953 | Ac-IRKSDELL-NH2 | 815 |
| 954 | Decanoyl-IRKSDELL-NH2 | 815 |
| 955 | Acetyl-Aca-Aca-IRKSDELL-NH2 | 1530 |
| 956 | Ac-YDASISQV-NH2 | 816 |
| 957 | Ac-NEKINQSL-NH2 | 817 |
| 958 | Ac-SISQVNEEINQALAYIRKADELL-NH2 | 818 |
| 959 | Ac-QVNEEINQALAYIRKADELL-NH2 | 819 |
| 960 | Ac-EEINQALAYIRKADELL-NH | 820 |
| 961 | Ac-NQALAYIRKADELL-NH2 | 821 |
| 962 | Ac-LAYIRKADELL-NH2 | 822 |
| 963 | FDASISQVNEKINQALAFIRKSDELL-NH2 | 823 |
| 964 | Ac-W-Nle-EWDREINNYTSLIHSLIEESQNQQEKNEQELLEL-NH2 | 1531 |
| 965 | Ac-ASRKCRAKFKQLLQHYREVAAAKSSENDRLRLLLKQMCPSLDVDS-NH2 | 825 |
| 967 | Ac-WLEWDREINNYTSLIHSLIEESQNQQEKNEQELLEL-NH2 | 827 |
| 968 | Ac-YVKGEPIINFYDPLVFPSDEFDASISQVNEKINQSL-NH2 | 828 |
| 969 | Ac-VYPSDEYDASISQVNEEINQSLAYIRKADELLHNV-NH2 | 829 |
| 970 | Ac-YDASISQVNEEINQALAYIRKADELLENV-NH2 | 830 |
| 971 | Ac-YDASISQVNEEINQALAYIRKADELLE-NH2 | 831 |
| 972 | Ac-VYPSDEYDASISQVNEEINQALAYIRKAAELLHNV-NH2 | 832 |
| 973 | Ac-VYPSDEYDASISQVNEEINQALAYIRKALELLHNV-NH2 | 833 |
| 974 | Decanoyl-YTSLIHSLIEESQNQQEKNEQELLELDKWASLWNWF-NH2 | 834 |
| 975 | Ac-VYPSDEYDASISQVNEEINQLLAYIRKLDELLENV-NH2 | 835 |
| 976 | Ac-DEYDASISQVNEKINQSLAFIRKSDELL-NH2 | 836 |
| 977 | Ac-SNDQGSGYAADKESTQKAFDGIThKVNSVIEKTNT-NH2 | 837 |
| 978 | Ac-ESTQKAFDGITNKVNSVIEKTNTQFEAVGKEFGNLEKR-NH2 | 838 |
| 979 | Ac-DGITNKVNSVIEKTNTQFEAVGKEFGNLEKRLENLNK-NH2 | 839 |
| 980 | Ac-DSNVKNLYDKVRSQLRDNVKELGNGAFEFYHK-NH2 | 840 |
| 981 | Ac-RDNVKELGNGAFEFYHKADDEALNSVKNGTYDYPKY-NH2 | 841 |
| 982 | Ac-EFYHKADDEALNSVKNGTYDYPKY-NH2 | 842 |
| 983 | Ac-AAVALLPAVLLALLAPAADKESTQKAFDGITNKVNS-NH2 | 843 |
| 984 | Ac-AAVALLPAVLLALLAPAADSNVKNLYDKVRSQLRDN-NH2 | 844 |
| 985 | Ac-KESTQKAFDGITNKVNSV-NH2 | 845 |
| 986 | Ac-IEKTNTQFEAVGKEFGNLER-NH2 | 846 |
| 987 | Ac-RLENLNKRVEDGFLDVWTYNAELLVALENE-NH2 | 847 |
| 988 | Ac-SNVKNLYDKVRSQLRDN-NH2 | 848 |
| 989 | Ac-WMEWDREINNYTSLIHSLIEESQNQQEKNEQEL-NH2 | 849 |
| 990 | Ac-WMEWDREINNYTSLIHSLIEESQNQQEKNEQE-NH2 | 850 |
| 991 | Ac-MEWDREINNYTSLIHSLIEESQNQQEKNEQEL-NH2 | 851 |
| 992 | Ac-MEWDREINNYTSLIHSLIEESQNQQEKNEQE-NH2 | 852 |
| 993 | Ac-EWDREINNYTSLIHSLIEESQNQQEKNEQELLE-NH2 | 853 |
| 994 | Ac-EWDREINNYTSLIHSLIEESQNQQEKNEQELL-NH2 | 854 |
| 995 | Ac-EWDREINNYTSLIHSLIEESQNQQEKNEQEL-NH2 | 855 |
| 996 | Ac-YTKFIYTLLEESQNQQEKNEQELLELDKWASLWNWF-NH2 | 856 |
| 997 | Ac-YMKQLADSLMQLARQVSRLESA-NH2 | 857 |
| 998 | Ac-YLMQLARQMKQLADSLMQLARQVSRLESA-NH2 | 858 |
| 999 | Ac-YQEWERKVDFLEENITALLEEAQIQQEKNMYELQKL-NH2 | 859 |
| 1000 | Ac-WMAWAAAINNYTSLIHSLIEESQNQQEKNEQEEEE-NH2 | 860 |
| 1001 | Ac-YASLIAALIEESQNQQEKNEQELLELAKWAALWAWF-NH2 | 861 |
| 1002 | [Ac-EWDREINNYTSLIHSLIEESQNQQEKNEQEGGC-NH2]dimer | 862 |
| 1003 | Ac-YDISIELNKAKSDLEESKEWIKKSNQKLDSIGNWH-NH2 | 863 |
| 1004 | Biotinyl-IDISIELNKAKSDLEESKEWIKKSNQKLDSIGNWH-NH2 | 548 |
| 1005 | Ac-YTSLI-OH | 865 |
| 1006 | Fmoc-HSLIEE-OH | 866 |
| 1007 | Fmoc-SQNQQEK-OH | 867 |
| 1008 | Fmoc-NEQELLEL-OH | 868 |
| 1009 | Fmoc-DKWASL-OH | 869 |
| 1010 | Fmoc-WNWF-OH | 870 |
| 1011 | Ac-AKTLERTWDTLNHLLFISSALYKLNLKSVAQITLSI-NH2 | 871 |
| 1012 | Ac-NITLQAKIKQFINMWQEVGKAMYA-NH2 | 872 |
| 1013 | Ac-LENERTLDFHDSNVKNLYDKVRLQLRDN-NH2 | 873 |
| 1014 | Ac-LENERTLDFHDSNVKNLYDKVRLQLRDNVKELGNG-NH2 | 874 |
| 1015 | Ac-TLDFHDSNVKNLYDKVRLQLRDNVKELGNGAFEF-NH2 | 875 |
| 1016 | Ac-IDISIELNKAKSDLEESKEWIKKSNQKLDSIGNWH-NH2 | 548 |

TABLE 1-continued

| T No. | Sequence | Seq. ID No. |
|---|---|---|
| 1021 | Biotinyl-SISQVNEEINQALAYIRKADELL-NH2 | 877 |
| 1022 | Biotinyl-SISQVNEEINQSLAYIRKSDELL-NH2 | 878 |
| 1023 | Ac-SISQVNEEINQSLAYIRKSDELL-NH2 | 879 |
| 1024 | Ac-IDISIELNKAKSDLEESKEWIEKSNQELDSIGNWE-NH2 | 39 |
| 1025 | Ac-IDISIELNKAKSDLEESKEWIKKSNQELDSIGNWH-NH2 | 864 |
| 1026 | Ac-IDISIELNKAKSDLEEAKEWIKKANQKLDSIGNWH-NH2 | 79 |
| 1027 | Ac-IDISIELNKAKSDLEESKEWIKKANQKLDSIGNWH-NH2 | 80 |
| 1028 | Ac-IDISIELNKAKSDLEEAKEWIKKSNQKLDSIGNWH-NH2 | 548 |
| 1029 | Biotinyl-NSVALDPIDISIELNKAKSDLEESKEWIKKSNQKL-NH2 | 880 |
| 1030 | Biotinyl-ALDPIDISIELNKAKSDLEESKEWIKKSNQKLDSI-NH2 | 881 |
| 1031 | desAminoTyrosine-NSVALDPIDISIELNKAKSDLEESKEWIKKSNQKL-NH2 | 882 |
| 1032 | desAminoTyrosine-ALDPIDISIELNKAKSDLEESKEWIKKSNQKLDSI-NH2 | 883 |
| 1033 | Ac-YDASISQVNEEINQALAFIRKADEL-NH2 | 1533 |
| 1034 | Ac-YDASISQVNEEINQSLAYIRKADELL-NH2 | 1534 |
| 1035 | Biotinyl-YDASISQVNEEINQALAYIRKADELL-NH2 | 890 |
| 1036 | Biotinyl-YDASISQVNEEINQSLAFIRKSDELL-NH2 | 885 |
| 1037 | Ac-YDASISQVNEEINQSLAFIRKSDELL-NH2 | 885 |
| 1038 | Ac-WLEWDREINNYTSLIHSLIEESQNQQEKNEQEL-NH2 | 887 |
| 1039 | Biotinyl-IDISIELNKAKSDLEESKEWIRRSNQKLDSIGNWH-NH2 | 888 |
| 1044 | Ac-YESTQKAFDGITNKVNSVIEKTNTQFEAVGKEFGNLEKR-NH2 | 81 |
| 1045 | Biotin-DEYDASISQVNEKINQSLAFIRKSDELL-NH2 | 82 |
| 1046 | Ac-MEWDREINNYTSLIHSLIEESQNQQEKNEQELL-NH2 | 571 |
| 1047 | Ac-WQEWEQKVRYLEANISQSLEQAQIQQEKNMYEL-NH2 | 892 |
| 1048 | Ac-WQEWEQKVRYLEANISQSLEQAQIQQEKNEYEL-NH2 | 893 |
| 1049 | Ac-WQEWEQKVRYLEANITALLEQAQIQQEKNEYEL-NH2 | 894 |
| 1050 | Ac-WQEWEQKVRYLEANITALLEQAQIQQEKNMYEL-NH2 | 895 |
| 1051 | Ac-WQEWEQKVRYLEANISQSLEQAQIQQEKNEYELQKL-NH2 | 896 |
| 1052 | Ac-WQEWEQKVRYLEANITALLEQAQIQQEKNEYELQKL-NH2 | 897 |
| 1053 | Ac-WQEWEQKVRYLEANITALLEQAQIQQEKNMYELQKL-NH2 | 898 |
| 1054 | Ac-IDISIELNKAKSDLEESKEWIEKSNQKLDSIGNWH-NH2 | 1535 |
| 1055 | Ac-EFGNLEKRLENLNKRVEDGFLDVWTYNAELLVALENE-NH2 | 899 |
| 1056 | Ac-EDGFLDVWTYNAELLVLMENERTLDFHDSNVKNLYDKVRMQL-NH2 | 900 |
| 1057 | Ac-SISQVNEKINQSLAFIRKSDELL-NH2 | 901 |
| 1058 | desaminoTyr-SISQVNEKINQSLAFIRKSDELL-NH2 | 902 |
| 1059 | Ac-SISQVNEKINQSLAYIRKSDELL-NH2 | 903 |
| 1060 | Ac-QQLLDVVKRQQEMLRLTVWGTKNLQARVTAIEKYLKDQ-NH2 | 904 |
| 1061 | YTSLIHSLIEESQNQQEKNEQELLELDKWASLWNWFC | 905 |
| 1062 | Ac-FDASISQVNEKINQSLAYIRKSDELL-NH2 | 906 |
| 1063 | Ac-YTSLIHSLIEESQNQQEKNEQELLELDKWA | 907 |
| 1064 | Indole-3-acetyl-DEFDASISQVNEKINQSLAFIRKSDELL-NH2 | 908 |
| 1065 | Indole-3-acetyl-DEFDESISQVNEKINQSLAFIRKSDELL-NH2 | 909 |
| 1066 | Indole-3-acetyl-DEFDESISQVNEKIEQSLAFIRKSDELL-NH2 | 910 |
| 1067 | Indole-3-acetyl-DEFDESISQVNEKIEESLAFIRKSDELL-NH2 | 911 |
| 1068 | Indole-3-acetyl-DEFDESISQVNEKIEESLQFIRKSDELL-NH2 | 912 |
| 1069 | Indole-3-acetyl-GGGGGDEFDASISQVNEKINQSLAFIRKSDELL-NH2 | 913 |
| 1070 | 2-Napthoyl-DEFDASISQVNEKINQSLAFIRKSDELL-NH2 | 914 |
| 1071 | desNH2Tyr-DEFDASISQVNEKINQSLAFIRKSDELL-NH2 | 915 |
| 1072 | biotin-ALDPIDISIELNKAKSDLEESKEWIRRSNQKLDSI-NH2 | 916 |
| 1073 | Ac-YDASISQVNEKINQALAYIRKADELLHNVNAGKST-NH2 | 917 |
| 1074 | Ac-VYFSDEYDASISQVNEKINQALAYIRKADELLHNV-NH2 | 918 |
| 1075 | Ac-VYPSDEYDASISQVNEKINQSLAYIRKSDELLHNV-NH2 | 1536 |
| 1076 | Ac-WGWGYGYG-NH2 | 919 |
| 1077 | Ac-YGWGWGWGF-NH2 | 920 |
| 1078 | Ac-WQEWEQKVRYLEANITALQEQAQIQAEKAEYELQKL-NH2 | 921 |
| 1079 | Ac-WQEWEQKVRYLEAEITALQEEAQIQAEKAEYELQKL-NH2 | 922 |
| 1081 | Ac-YTSLIHSLIEESQNQQEKNEQELLELDKWAS | 923 |
| 1082 | Ac-VWPSDEFDASISQVNEKINQSLAFIRKSDELLHNV-NH2 | 924 |
| 1083 | Ac-SKNISEQIDQIKKDEQKEGTGWGLGGKWWTSDWGV-NH2 | 925 |
| 1084 | Ac-LSKNISEQIDQIKKDEQKEGTGWGLGGKWWTSDWG-NH2 | 926 |
| 1085 | Ac-DLSKNISEQIDQIKKDEQKEGTGWGLGGKWWTSDW-NH2 | 927 |
| 1086 | Ac-EDLSKNISEQIDQIKKDEQKEGTGWGLGGKWWTSD-NH2 | 928 |
| 1087 | Ac-IEDLSKNISEQIDQIKKDEQKEGTGWGLGGKWWTS-NH2 | 929 |
| 1088 | Ac-GIEDLSKNISEQIDQIKKDEQKEGTGWGLGGKWWT-NH2 | 930 |
| 1089 | Ac-IGIEDLSKNISEQIDQIKKDEQKEGTGWGLGGKWW-NH2 | 931 |
| 1090 | 2-Napthoyl--PSDEFDASISQVNEKINQSLAFIRKSDELLFHNVN-NH2 | 932 |
| 1091 | Ac-VYPSDEYDASISQVNEKINQALAYIRKADELLENV-NH2 | 933 |
| 1092 | Ac-VYPSDEFDASISQVNEKINQALAFIRKADELLENV-NH2 | 934 |
| 1093 | Ac-VYPSDEYDASISQVNEKINQALAYIREADELLENV-NH2 | 935 |
| 1094 | Biotinyl-YDASISQVNEKINQSLAFIRESDELL-NH2 | 936 |
| 1095 | Ac-AIGIEDLSKNISEQIDQIKKDEQKEGTGWGLGGKW-NH2 | 937 |
| 1096 | Ac-AAIGIEDLSKNISEQIDQIKKDEQKEGTGWGLGGK-NH2 | 938 |
| 1097 | Ac-DAAIGIEDLSKNISEQIDQIKKDEQKEGTGWGLGG-NH2 | 939 |
| 1098 | Ac-PDAAIGIEDLSKNISEQIDQIKKDEQKEGTGWGLG-NH2 | 940 |
| 1099 | Ac-NITDKIDQIIHDFVDKTLPDQGDNDNWWTGWRQWI-NH2 | 941 |
| 1100 | Ac-KNITDKIDQIIHDFVDKTLPDQGDNDNWWTGWRQW-NH2 | 942 |
| 1101 | Ac-TKNITDKIDQIIHDFVDKTLPDQGDNDNWWTGWRQ-NH2 | 943 |

TABLE 1-continued

| T No. | Sequence | Seq. ID No. |
|---|---|---|
| 1102 | Ac-WTKNITDKIDQIIHDFVDKTLPDQGDNDNWWTGWR-NH2 | 944 |
| 1103 | Ac-DWTKNITDKIDQIIHDFVDKTLPDQGDNDNWWTGW-NH2 | 945 |
| 1104 | Ac-HDWTKNITDKIDQIIHDFVDKTLPDQGDNDNWWTG-NH2 | 946 |
| 1105 | Ac-PHDWTKNITDKIDQIIHDFVDKTLPDQGDNDNWWT-NH2 | 947 |
| 1106 | Ac-EPHDWTKNITDKIDQIIHDFVDKTLPDQGDNDNWW-NH2 | 948 |
| 1107 | Ac-IEPHDWTKNITDKIDQIIHDFVDKTLPDQGDNDNW-NH2 | 949 |
| 1108 | Ac-AIEPHDWTKNITDKIDQIIHDFVDKTLPDQGDNDN-NH2 | 950 |
| 1109 | Ac-AAIEPHDWTKNITDKIDQIIHDFVDKTLPDQGDND-NH2 | 951 |
| 1110 | Ac-DAAIEPHDWTKNITDKIDQIIHDFVDKTLPDQGDN-NH2 | 952 |
| 1111 | Ac-LSPTVWLSVIWMMWYWGPSLYSILSPFLPLLPIFF-NH2 | 953 |
| 1112 | Ac-GLSPTVWLSVIWMMWYWGPSLYSILSPFLPLLPIF-NH2 | 1345 |
| 1113 | Ac-VGLSPTVWLSVIWMMWYWGPSLYSILSPFLPLLPI-NH2 | 1346 |
| 1114 | Ac-FVGLSPTVWLSVIWMMWYWGPSLYSILSPFLPLLP-NH2 | 1347 |
| 1115 | Ac-WFVGLSPTVWLSVIWMMWYWGPSLYSILSPFLPLL-NH2 | 1348 |
| 1116 | Ac-QWFVFLSPTVWLSVIWMMWYWGPSLYSILSPFLPL-NH2 | 1537 |
| 1117 | Ac-VQWFVGLSPTVWLSVIWMMWYWGPSLYSILSPFLP-NH2 | 1350 |
| 1118 | Ac-FVQWFVGLSPTVWLSVIWMMWYWGPSLYSILSPFL-NH2 | 1351 |
| 1119 | Ac-PFVQWFVGLSPTVWLSVIWMMWYWGPSLYSILSPF-NH2 | 1352 |
| 1120 | Ac-VPFVQWFVGLSPTVWLSVIWMMWYWGPSLYSILSP-NH2 | 1353 |
| 1121 | Ac-LVPFVQWFVGLSPTVWLSVIWMMWYWGPSLYSILS-NH2 | 1354 |
| 1122 | H-NHTTWMEWDREINNYTSLIHSLIEESQNQQEKNEQELLELDKW-OH | 954 |
| 1123 | H-QARQLLSGIVQQQNNLLRAIEAQQHLLQLTVWGIKQLQARILAVERYLKDQ-OH | 955 |
| 1124 | Ac-VYPSDEFDASISQVNEKINQSLAFIREADELLENV-NH2 | 956 |
| 1125 | Ac-VFPSDEFDASISQVNEKINQSLAYIREADELLENV-NH2 | 957 |
| 1126 | Ac-DEFDASISQVNEKINQSLAYIREADELL-NH2 | 958 |
| 1127 | Ac-NEQELLELDKWASLWNWFGGGGDEFDASISQVNEKINQSLAFIRKSDELL-NH2 | 959 |
| 1128 | Ac-LELDKWASLWNWFGGGGDEFDASISQVNEKINQSLAFIRKSDELL-NH2 | 960 |
| 1129 | Naphthoyl-EGEGEGEGDEFDASISQVNEKINQSLAFIRKSDELL-NH2 | 961 |
| 1130 | Ac-ASRKCRAKFKQLLQHYREVAAAKSSENDRLRLLLKQMCPSLDV-NH2 | 962 |
| 1131 | Naphthoyl-GDEEDASISQVNEKINQSLAFIRKSDELL-NH2 | 963 |
| 1132 | Naphthoyl-GDEEDASESQVNEKINQSLAFIRKSDELL-NH2 | 964 |
| 1133 | Naphthoyl-GDEEDASESQQNEKINQSLAFIRKSDELL-NH2 | 965 |
| 1134 | Naphthoyl-GDEEDASESQQNEKQNQSLAFIRKSDELL-NH2 | 966 |
| 1135 | Naphthoyl-GDEEDASESQQNEKQNQSEAFIRKSDELL-NH2 | 967 |
| 1136 | Ac-WGDEFDESISQVNEKIEESLAFIRKSDELL-NH2 | 968 |
| 1137 | Ac-YTSLGGDEFDESISQVNEKIEESLAFIRKSDELLGGWNWF-NH2 | 969 |
| 1138 | Ac-YTSLIHSLGGDEFDESISQVNEKIEESLAFIRKSDELLGGWASLWNWF-NH | 970 |
| 1139 | 2-Naphthoyl-GDEFDESISQVNEKIEESLAFIRKSDELL-NH2 | 971 |
| 1140 | 2-Naphthoyl-GDEEDESISQVNEKIEESLAFIRKSDELL-NH2 | 972 |
| 1141 | 2-Naphthoyl-GDEEDESISQVQEKIEESLAFIRKSDELL-NH2 | 973 |
| 1142 | 2-Naphthoyl-GDEEDESISQVNEKIEESLLFIRKSDELL-NH2 | 974 |
| 1143 | Biotin-GDEYDESISQVNEKIEESLAFIRKSDELL-NH2 | 975 |
| 1144 | 2-Naphthoyl-GDEYDESISQVNEKIEESLAFIRKSDELL-NH2 | 976 |
| 1145 | Ac-YTSLIHSLIDEQEKIEELAFIRKSDELLELDKWNWF-NH2 | 977 |
| 1146 | VYPSDEYDASISQVNEEINQALAYIRKADELLENV-NH2 | 978 |
| 1147 | Ac-NNLLRAIEAQQHLLQLTVWGSKQLQARILAVERYLKDQ-NH2 | 979 |
| 1148 | GGGVYPSDEYDASISQVNEEINQALAYIRKADELLENV-NH2 | 980 |
| 1149 | Ac-NNLLRAIEAQQHLLQLTVWGEKQLQARILAVERYLKDQ-NH2 | 981 |
| 1150 | Ac-PTRVNYILIIGVLVLAbuEVTGVRADVHLL-NH2 | 1538 |
| 1151 | Ac-PTRVNYILIIGVLVLAbuEVTGVRADVHLLEQPGNLW-NH2 | 1539 |
| 1152 | Ac-PEKTPLLPTRVNYILIIGVLVLAbuEVTGVRADVHLL-NH2 | 1540 |
| 1153 | AhaGGGVYPSDEYDASISQVNEEINQALAYIRKADELLENV-NH2 | 1541 |
| 1155 | Ac-YTSLIHSLGGDEFDESISQVNEKIEESLAFIRKSDELL-NH2 | 986 |
| 1156 | Ac-YTSLGGDEFDESISQVNEKIEESLAFIRKSDELL-NH2 | 987 |
| 1157 | Ac-DEFDESISQVNEKIEESLAFIRKSDELLGGWASLWNWF-NH2 | 988 |
| 1158 | Ac-DEFDESISQVNEKIEESLAFIRKSDELLGGWNWF-NH2 | 989 |
| 1159 | Ac-YTSLIHSLIEESQNQQEKNEQELLELDKASLWNWF-NH2 | 990 |
| 1160 | Ac-YTSLIHSLIEESQNQQEKNEQELLELDKSLWN WF-NH2 | 991 |
| 1161 | Ac-YTSLIHSLIEESQNQQEKNEQELLELDKLWNWF-NH2 | 992 |
| 1162 | Ac-YTSLIHSLIEESQNQQEKNEQELLELDKWNWF-NH2 | 993 |
| 1163 | Ac-MTWMEWDREINNYTSLIHSLIEESQNQQEKNEQELLELDKASLWNWF-NH2 | 994 |
| 1164 | Ac-MTWMEWDREINNYTSLIHSLIEESQNQQEKNEQELLELDKSLWNWF-NH2 | 995 |
| 1165 | Ac-MTWMEWDREINNYTSLIHSLIEESQNQQEKNEQELLELDKLWNWF-NH2 | 996 |
| 1166 | Ac-MTWMEWDREINNYTSLIHSLIEESQNQQEKNEQELLELDKWNWF-NH2 | 997 |
| 1167 | Ac-MTWMEWDREINNYTSLIHSLIEESQNQQEKNEQELLELDKWASLWN-NH2 | 998 |
| 1168 | Ac-MTWMEWDREINNYTSLIHSLIEESQNQQEKNEQELLELDKWASL-NH2 | 999 |
| 1169 | (Pyr)HWSY(2-napthyl-D-Ala)LRPG-NH2 | 1542 |
| 1170 | Ac-WNWFDEFDESISQVNEKIEESLAFIRKSDELLWNWF-NH2 | 1001 |
| 1171 | Ac-YTSLIHSLIEESQNQQEKNEQELLELDKYASLYNYF-NH2 | 1002 |
| 1172 | Ac-YTSLIHSLIEESQNQQEKNEQELLELDKYAYLYNYF-NH2 | 1003 |
| 1173 | 2-Naphthoyl-AcaAcaAcaDEFDESISQVNEKIEESLAFIRKSDELLAcaAcaAcaW-NH2 | 1543 |
| 1174 | 2-Naphthoyl-AcaAcaAcaGDEFDESISQVNEKIEESLAFIRKSDELLAcaAcaAcaW-NH2 | 1544 |
| 1175 | 2-Naphthoyl-GDEFDESISQVNEKIEESLAFIRESDELL-NH2 | 1006 |
| 1176 | 2-Naphthoyl-GDEFDESISQVNEKIEESLAFIEESDELL-NH2 | 1007 |
| 1177 | Ac-WQEWEQKVNYLEANITALLEQAQIQQEKNEYELQKL-NH2 | 1008 |
| 1178 | Ac-WQEWEQKVDYLEANITALLEQAQIQQEKNEYELQKL-NH2 | 1009 |

TABLE 1-continued

| T No. | Sequence | Seq. ID No. |
|---|---|---|
| 1179 | Ac-WQEWEQKVRWLEANITALLEQAQIQQEKNEYELQKL-NH2 | 1010 |
| 1180 | Ac-WQEWEKQVRYLEANITALLEQAQIQQEKNEYELQKL-NH2 | 1011 |
| 1181 | Ac-WQEWEHQVRYLEANITALLEQAQIQQEKNEYELQKL-NH2 | 1012 |
| 1182 | Ac-WQEWEHKVRYLEANITALLEQAQIQQEKNEYELQKL-NH2 | 1013 |
| 1183 | Ac-WQEWDREVRYLEANITALLEQAQIQQEKNEYELQKL-NH2 | 1014 |
| 1184 | Ac-WQEWEREVRYLEANITALLEQAQIQQEKNEYELQKL-NH2 | 1015 |
| 1185 | Ac-WQEWERQVRYLEANITALLEQAQIQQEKNEYELQKL-NH2 | 1016 |
| 1186 | Ac-WQEWEQKVKYLEANITALLEQAQIQQEKNEYELQKL-NH2 | 1017 |
| 1187 | Ac-WQEWEQKVRFLEANITALLEQAQIQQEKNEYELQKL-NH2 | 1018 |
| 1188 | Ac-VNalPSDEYDASISQVNEEINQALAYIRKADELLENV-NH2 | 1545 |
| 1189 | Ac-VNalPSDENalDASISQVNEEINQALAYIRKADELLENV-NH2 | 1546 |
| 1190 | Ac-VNalPSDEYDASISQVNEEINQALANalIRKADELLENV-NH2 | 1547 |
| 1191 | Ac-VYPSDEFDASISQVNEKINQSLAFIREADELLFNFF-NH2 | 1022 |
| 1192 | Ac-VYPSDEYDASISQVNEEINQALAYIRKADELLFNFF-NH2 | 1023 |
| 1193 | Ac-YTSLITALLEQAQIQQEKNEYELQKLDKWASLWNWF-NH2 | 1024 |
| 1194 | Ac-YTSLITALLEQAQIQQEKNEYELQKLDKWASLWEWF-NH2 | 1548 |
| 1195 | Ac-YTSLITALLEQAQIQQEKNEYELQKLDEWASLWEWF-NH2 | 1026 |
| 1196 | Ac-YTSLITALLEQAQIQQEKNEYELQELDEWASLWEWF-NH2 | 1027 |
| 1197 | Ac-YTSLITALLEEAQIQQEKNEYELQELDEWASLWEWF-NH2 | 1028 |
| 1198 | Naphthoyl-Aua-Aua-Aua-TALLEQAQIQQEKNEYELQKLAua-Aua-Aua-W-NH2 | 1549 |
| 1199 | Ac-WAAWEQKVRYLEANITALLEQAQIQQEKNEYELQKL-NH2 | 1030 |
| 1200 | Ac-WQEAAQKVRYLEANITALLEQAQIQQEKNEYELQKL-NH2 | 1031 |
| 1201 | Ac-WQEWAAKVRYLEANITALLEQAQIQQEKNEYELQKL-NH2 | 1032 |
| 1202 | Ac-WQAAEQKVRYLEANITALLEQAQIQQEKNEYELQKL-NH2 | 1550 |
| 1203 | Ac-WQEWEAAVRYLEANITALLEQAQIQQEKNEYELQKL-NH2 | 1551 |
| 1204 | Ac-WQEWEQAARYLEANITALLEQAQIQQEKNEYELQKL-NH2 | 1552 |
| 1205 | Ac-WQEWEQKAAYLEANITALLEQAQIQQEKNEYELQKL-NH2 | 1553 |
| 1206 | Ac-WQEWEQKVAALEANITALLEQAQIQQEKNEYELQKL-NH2 | 1554 |
| 1207 | Ac-WQEWEQKVRYLEANITALLEQAQIQQEKNEYELQKLGGGGWASLWNF-NH2 | 1555 |
| 1208 | 2-Naphthoyl-GDEFDASISQVNEKINQSLAFIRKSDELT-NH2 | 1039 |
| 1209 | 2-Naphthoyl-GDEFDASISQVNEKINQSLAFTRKSDELT-NH2 | 1040 |
| 1210 | 2-Naphthoyl-GDEFDASISQVNEKTNQSLAFTRKSDELT-NH2 | 1037 |
| 1211 | 2-Naphthoyl-GDEFDASISQTNEKTNQSLAFTRKSDELT-NH2 | 1038 |
| 1212 | 2-Naphthoyl-GDEFDASTSQTNEKTNQSLAFTRKSDELT-NH2 | 1039 |
| 1213 | 2-Naphthoyl-GDEYDASTSQTNEKTNQSLAFTRKSDELT-NH2 | 1040 |
| 1214 | 2-Naphthoyl-GDEFDEEISQVNEKIEESLAFIRKSDELL-NH2 | 1041 |
| 1215 | 2-Naphthoyl-GDEFDASISQVNEKINQSLAFIRKSDELA-NH2 | 1042 |
| 1216 | 2-Naphthoyl-GDEFDASASQANEKANQSLAFARKSDELA-NH2 | 1043 |
| 1217 | 2-Naphthoyl-GDEFDESISQVNEKIEESLAFTRKSDELL-NH2 | 1044 |
| 1218 | 2-Naphthoyl-GDEFDESISQVNEKTEESLAFIRKSDELL-NH2 | 1045 |
| 1219 | 2-Naphthoyl-GDEFDESISQTNEKIEESLAFIRKSDELL-NH2 | 1046 |
| 1220 | 2-Naphthoyl-GDEFDESTSQVNEKIEESLAFIRKSDELL-NH2 | 1047 |
| 1221 | Ac-WNWFDEFDESTSQVNEKIEESLAFIRKSDELLWNWF-NH2 | 1048 |
| 1222 | Ac-WNWFDEFDESTSQTNEKIEESLAFIRKSDELLWNWF-NH2 | 1049 |
| 1223 | Ac-WNWFDEFDESTSQTNEKTEESLAFIRKSDELLWNWF-NH2 | 1050 |
| 1224 | Ac-LQAGFFLLTRILTIPQSLDSWWTSLNFLGGTTVAL-NH2 | 1355 |
| 1225 | Ac-YThLIYTLLEESQNQQEKNEQELLELDKWASLWSWF-NH2 | 1051 |
| 1226 | Ac-WQEWEQKVRYLEANITALLEQAQIQQEKNEYELQKLDKWASLWNWF-NH2 | 1052 |
| 1227 | Ac-NNMTWQEWEQKVRYLEANITALLEQAQIQQEKNEYELQKLDKWASLWNWF-NH2 | 1053 |
| 1230 | Ac-WNWFIEESDELLWNWF-NH2 | 1054 |
| 1231 | 2-Naphthoyl-GFIEESDELLW-NH2 | 1055 |
| 1232 | Ac-WFIEESDELLW-NH2 | 1056 |
| 1233 | 2-Naphthoyl-GFNFFIEESDELLFNFF-NH2 | 1057 |
| 1234 | 2-Naphthoyl-GESDELW-NH2 | 1058 |
| 1235 | Ac-WNWFGDEFDESISQVQEEIEESLAFIEESDELLGGWNWF-NH2 | 1059 |
| 1236 | Ac-WNWFIHSLIEESQNQQEKNEQELLELDKWASLWNWF-NH2 | 1356 |
| 1237 | Ac-YTSLITALLEQAQIQQEENEYELQALDEWASLWEWF-NH2 | 1025 |
| 1238 | Ac-YTSLIHSLGGDEFDESISQVNEEIEESLAFIEESDELLGGWASLWNWF-NH2 | 1060 |
| 1239 | 2-Naphthoyl-GDEFDESISQVQEEIEESLAFIEESDELL-NH2 | 1061 |
| 1240 | H-QARQLLSSIMQQQNNLLRAIEAQQHLLQLTVWGIKQLQARILAVERYLKDQ-OH | 1062 |
| 1241 | Ac-CPKYVKQNTLKLATGMRNVPEKQTR-NH2 | 1063 |
| 1242 | Ac-GLFGAIAGFIENGWEGMIDGWYGFRHQNSC-NH2 | 1064 |
| 1243 | Ac-LNFLGGT-NH2 | 1065 |
| 1244 | Ac-LDSWWTSLNFLGGT-NH2 | 1066 |
| 1245 | Ac-ILTIPQSLDSWWTSLNFLGGT-NH2 | 1067 |
| 1246 | Ac-GFFLLTRILTIPQSLDSWWTSLNFLGGT-NH2 | 1068 |
| 1247 | Ac-WQEWEQKITALLEQAQIQQEKNEYELQKLDKWASLWNWF-NH2 | 1069 |
| 1248 | Ac-WNWFITALLEQAQIQQEKNEYELQKLDKWASLWNWF-NH2 | 1070 |
| 1249 | Ac-WQEWEQKITALLEQAQIQQEKNEYELQKLDKWASLWEWF-NH2 | 1071 |
| 1250 | Ac-WQEWEQKVRYLEANITALLEQAQIQQEKIEYELQKL-NH2 | 1072 |
| 1251 | Ac-WQEWEQKVRYLEAQITALLEQAQIQQEKIEYELQKL-NH2 | 1073 |
| 1252 | Ac-KENKANGTDAKVKLIKQELDKYKNAVTELQLLMQS-NH2 | 1074 |
| 1253 | Ac-NIKENKANGTDAKVKLIKQELDKYKNAVTELQLLM-NH2 | 1075 |
| 1254 | (FS)-YTSLIHSLIEESQNQQEKNEQELLELDKWASLWNWF-NH2 | 1076 |
| 1255 | 2-Naphthoyl-GWNWFAcaDEFDESISQVQEEIEESLAFIEESDELLAcaWNWF-NH2 | 1556 |
| 1256 | Ac-WNWFGDEFDESISQVNEKIEESLAFIEESDELLGWNWF-NH2 | 1078 |

TABLE 1-continued

| T No. | Sequence | Seq. ID No. |
|---|---|---|
| 1257 | Ac-WNWFGDEFDESISQVNEKIEESLAFIRKSDELLGWNWF-NH2 | 1079 |
| 1258 | Ac-WNWF-Aca-DEFDESISQVNEKIEESLAFIRKSDELL-Aca-WNWF-NH2 | 1557 |
| 1259 | Ac-WNWF-Aca-DEFDESISQVNEKIEESLAFIEESDELL-Aca-WNWF-NH2 | 1558 |
| 1260 | Ac-EESQNQQEKNEQELLELDKWA-NH2 | 1082 |
| 1261 | EESQNQQEKNEQELLELDKWA | 1083 |
| 1262 | Ac-CGTTDRSGAPTYSWGANDTDVFVLNNTRPPLGNWFG-NH2 | 1084 |
| 1263 | Ac-GVEHRLEAACNWTRGERADLEDRDRSELSP-NH2 | 1085 |
| 1264 | Ac-CVREGNASRAWVAVTPTVATRDGKLPT-NH2 | 1086 |
| 1265 | Ac-CFSPRHHWTTQDANASIYPG-NH2 | 1087 |
| 1266 | Ac-LQHYREVAAAKSSENDRLRLLLKQMCPSLDVDS-NH2 | 1088 |
| 1267 | Ac-WQEWDREISNYTSLITALLEQAQIQQEKNEYELQKLDEWASLWEWF-NH2 | 1089 |
| 1268 | Ac-CWQEWDREISNYTSLITALLEQAQIQQEKNEYELQKLDEWASLWEWFC-NH2 | 1090 |
| 1269 | Ac-WQEWDREISNYTSLITALLEQAQIQQEKNEYELQKLDEWEWF-NH2 | 1091 |
| 1270 | Ac-CWQEWDREISNYTSLITALLEQAQIQQEKNEYELQKLDEWEWFC-NH2 | 1092 |
| 1271 | Ac-GQNSQSPTSNHSPTSAPPTAPGYRWA-NH2 | 1093 |
| 1272 | Ac-PGSSTTSTGPARTALTTAQGTSLYPSA-NH2 | 1094 |
| 1273 | Ac-PGSSTTSTGPARTALTTAQGTSLYPSAAATKPSDGNATA-NH2 | 1095 |
| 1275 | Ac-WQEWDREITALLEQAQIQQEKNEYELQKLDKWASLWNWF-NH2 | 1097 |
| 1276 | Ac-WQEWDREITALLEQAQIQQEKNEYELQKLDEWASLWEWF-NH2 | 1098 |
| 1277 | Ac-WQEWDREITALLEQAQIQQEKNEYELQKLDEWEWF-NH2 | 1099 |
| 1278 | Ac-WQEWEREITALLEQAQIQQEKNEYELQKLDEWEWF-NH2 | 1100 |
| 1279 | Ac-WQEWEREITALLEQAQIQQEKNEYELQKLIEWEWF-NH2 | 1101 |
| 1280 | Ac-WQEWEREITALLEQAQIQQEKIEYELQKLDEWEWF-NH2 | 1102 |
| 1281 | Ac-WQEWEITALLEQAQIQQEKNEYELQKLDEWEWF-NH2 | 1103 |
| 1282 | Ac-WQEWEITALLEQAQIQQEKNEYELQKLIEWEWF-NH2 | 1104 |
| 1283 | Ac-WQEWEITALLEQAQIQQEKIEYELQKLDEWEWF-NH2 | 1105 |
| 1284 | Ac-WQEWEITALLEQAQIQQEKIEYELQKLIEWEWF-NH2 | 1106 |
| 1285 | Ac-WQEWDREIDEYDASISQVNEKINQALAYIREADELWEWF-NH2 | 1107 |
| 1286 | Ac-WQEWEREIDEYDASISQVNEKINQALAYIREADELWEWF-NH2 | 1108 |
| 1287 | Ac-WQEWEIDEYDASISQVNEKINQALAYIREADELWEWF-NH2 | 1109 |
| 1288 | Ac-WQEWDREIDEYDASISQVNEEINQALAYIREADELWEWF-NH2 | 1110 |
| 1289 | Ac-WQEWEREIDEYDASISQVNEEINQALAYIREADELWEWF-NH2 | 1111 |
| 1290 | Ac-WQEWEIDEYDASISQVNEEINQALAYIREADELWEWF-NH2 | 1112 |
| 1291 | Ac-WQEWDEYDASISQVNEKINQALAYIREADELWEWF-NH2 | 1113 |
| 1292 | Ac-WQEWDEYDASISQVNEEINQALAYIREADELWEWF-NH2 | 1114 |
| 1293 | Ac-WQEWEQKITALLEQAQIQQEKIEYELQKLIEWEWF-NH2 | 1115 |
| 1294 | Ac-WQEWEQKITALLEQAQIQQEKIEYELQKLIEWASLWEWF-NH2 | 1116 |
| 1295 | Ac-WQEWEITALLEQAQIQQEKIEYELQKLIEWASLWEWF-NH2 | 1117 |
| 1298 | -VYFSDEYDASISQVNEEINQALAYIRKADELLENV-NH2 | 1160 |
| 1299 | Ac-WVYPSDEYDASISQVNEEINQALAYIRKADELLENVWNWF-NH2 | 1120 |
| 1300 | YTSLIHSLIEESQNQQEKNEQELLELDKWASLWNWF-NH2 | 1121 |
| 1301 | Ac-WQEWDEYDASISQVNEKINQALAYIREADELWAWF-NH2 | 1122 |
| 1302 | Ac-WQAWDEYDASISQVNEKINQALAYIREADELWAWF-NH2 | 1123 |
| 1303 | Ac-WQAWDEYDASISQVNEKINQALAYIREADELWEWF-NH2 | 1124 |
| 1304 | Biotin-YDPLVFPSDEFDASISQVNEKINQSLAFIRKSDEL-NH2 | 1125 |
| 1305 | Biotin-YDPLVFPSDEFDASISQVNEKINQSLAF-NH2 | 1126 |
| 1306 | Biotin-QVNEKINQSLAFIRKSDELLHNVNAGKST-NH2 | 1127 |
| 1307 | Ac-WMEWDREI-NH2 | 1128 |
| 1308 | Ac-WQEWEQKI-NH2 | 1129 |
| 1309 | Ac-WQEWEQKITALLEQAQIQQEKIEYELQKLIKWASLWEWF-NH2 | 1130 |
| 1310 | Ac-WQEWEQKITALLEQAQIQQEKIEYELQKLIEWASLWEWF-NH2 | 1131 |
| 1311 | Ac-WQEWEREISAYTSLITALLEQAQIQQEKIEYELQKLIEWEWF-NH2 | 1132 |
| 1312 | Ac-WQEWEREISAYTSLITALLEQAQIQQEKIEYELQKEWEWF-NH2 | 1133 |
| 1313 | Ac-WQEWEREISAYTSLITALLEQAQIQQEKIEYELQKEWEW-NH2 | 1134 |
| 1314 | Ac-WQEWEREISAYTSLITALLEQAQIQQEKIEYELQKLIEWEW-NH2 | 1135 |
| 1315 | Ac-FNLSDHSESIQKKFQLMKKHVNKIGVDSDPIGSWLW-NH2 | 1136 |
| 1316 | Ac-DHSESIQKKFQLMKKHVNKIGVDSDPIGSWLRGIF-NH2 | 1137 |
| 1317 | Ac-WSVKQANLTTSLLGDLLDDVTSIRHAVLQNRA-NH2 | 1138 |
| 1318 | Biotin-WMEWDREI-NH2 | 1128 |
| 1319 | Biotin-NNMTWMEWDREINNYTSL-NH2 | 1139 |
| 1320 | Ac-GAASLTLTVQARQLLSGIVQQQNNLLRAIEAQQHLL-NH2 | 1140 |
| 1321 | Ac-ASLTLTVQARQLLSGIVQQQNNLLRAIEAQQHLLQL-NH2 | 1141 |
| 1322 | Ac-VSVGNTLYYVNKQEGKSLYVKGEPIINFYDPLVF-NH2 | 1142 |
| 1323 | Ac-QHWSYGLRPG-NH2 | 1143 |
| 1324 | Ac-WQEWEQKIQHWSYGLRPGWASLWEWF-NH2 | 1144 |
| 1325 | Ac-WQEWEQKIQHWSYGLRPGWEWF-NH2 | 1145 |
| 1326 | Ac-WNWFQHWSYGLRPGWNWF-NH2 | 1146 |
| 1327 | Ac-FNFFQHWSYGLRPGFNFF-NH2 | 1147 |
| 1328 | Ac-GAGAQHWSYGLRPGAGAG-NH2 | 1148 |
| 1329 | PLLVLQAGFFLLTRILTIPQSLDSWWTSLNFLGGT | 482 |
| 1330 | Ac-WQEWEQKITALLEQAQIQQEKIEYELQKLAKWASLWEWF-NH2 | 1149 |
| 1331 | Ac-WQEWEQKITALLEQAQIQQEKIEYELQKLAEWASLWEWF-NH2 | 1150 |
| 1332 | Ac-WQEWEQKITALLEQAQIQQEKAEYELQKLAEWASLWEWF-NH2 | 1151 |
| 1333 | Ac-WQEWEQKITALLEQAQIQQEKAEYELQKLAEWASLWAWF-NH2 | 1152 |
| 1334 | Ac-WQEWEQKITALLEQAQIQQEKAEYELQKLAKWASLWAWF-NH2 | 1153 |
| 1335 | Ac-TNKAVVSLSNGVSVLTSKVLDLKNYIDKQLLPIVNK-NH2 | 1154 |

TABLE 1-continued

| T No. | Sequence | Seq. ID No. |
|---|---|---|
| 1336 | Ac-KAVVSLSNGVSVLTSKVLDLKNYIDKQLLPIVNKQS-NH2 | 1155 |
| 1337 | Ac-WQEWEQKITALLEQAQIQQEKNEYELQKLIEWEWF-NH2 | 1156 |
| 1338 | Ac-WQEWEQKITALLEQAQIQQEKGEYELQKLIEWEWF-NH2 | 1157 |
| 1339 | Ac-WQEWEQKITALLEQAQIQQEKIEYELQKLDKWEWF-NH2 | 1158 |
| 1340 | Ac-YDPLVFPSDEFDASISQVNEKINQSLAF-NH2 | 1159 |
| 1341 | Fluor--VYPSDEYDASISQVNEEINQALAYIRKADELLENV-NH2 | 1160 |
| 1342 | Fluor-YTSLIHSLIEESQNQQEKNEQELLELDKWASLWNWF-NH2 | 1161 |
| 1344 | Ac-SGIVQQQNNLLRAIEAQQHLLQLTVWGIKQLQARIL-NH2 | 1162 |
| 1345 | Ac-QQQNNLLRAIEAQQHLLQLTVWGIKQLQARILAVERYLKDQ-NH2 | 1163 |
| 1346 | Ac-SGIVQQQNNLLRAIEAQQHLLQLTVWGIKQLQARILAVERYLKDQ-NH2 | 1164 |
| 1347 | Ac-WQEWEQKITALLEQAQIQQEKNEYELQKLAEWASLWAWF-NH2 | 1165 |
| 1348 | Ac-WQEWEQKITALLEQAQIQQEKNEYELQKLAEWASLWAW-NH2 | 1166 |
| 1349 | Ac-WQEWEQKITALLEQAQIQQEKAEYELQKLAEWASLWAW-NH2 | 1167 |
| 4350 | Ac-WQEWEQKITALLEQAQIQQEKNEYELQKLAEWAGLWAWF-NH2 | 1168 |
| 1351 | Ac-WQEWEQKITALLEQAQIQQEKNEYELQKLAEWAGLWAW-NH2 | 1169 |
| 1352 | Ac-WQEWEQKITALLEQAQIQQEKAEYELQKLAEWAGLWAW-NH2 | 1170 |
| 1353 | Ac-WQEWEQKITALLEQAQIQQEKNEYELQKLDKWAGLWEWF-NH2 | 1171 |
| 1354 | Ac-WQEWQHWSYGLRPGWEWF-NH2 | 1172 |
| 1355 | Ac-WQAWQHWSYGLRPGWAWF-NH2 | 1173 |
| 1356 | Biotinyl-WQEWEQKITALLEQAQIQQEKNEYELQKLDKWASLWEWF-NH2 | 1174 |
| 1357 | WQEWEQKITALLEQAQIQQEKNEYELQKLDKWASLWEWF | 1175 |
| 1358 | WQEWEQKITALLEQAQIQQEKIEYELQKLIEWEWF | 1176 |
| 1361 | Ac-AGSTMGARSMTLTVQARQLLSGIVQQQNNLLRAIEAQQ-NH2 | 1179 |
| 1362 | Ac-AGSAMGAASLTLSAQSRTLLAGIVQQQQQLLDVVKRQQ-NH2 | 1180 |
| 1363 | Ac-AGSAMGAASTALTAQSRTLLAGIVQQQQQLLDVVKRQQ-NH2 | 1181 |
| 1364 | Ac-ALTAQSRTLLAGIVQQQQQLLDVVKRQQELLRLTVWGT-NH2 | 1182 |
| 1365 | Ac-TLSAQSRTLLAGIVQQQQQLLDVVKRQQEMLRLTVWGT-NH2 | 1183 |
| 1366 | Ac-TLTVQARQLLSGIVQQQNNLLRAIEAQQHLLQLTVWGI-NH2 | 1184 |
| 1367 | Ac-WQAWIEYEAELSQVKEKIEQSLAYIREADELWAWF-NH2 | 1185 |
| 1368 | Ac-WQAWIEYEASLSQAKEKIEESKAYIREADELWAWF-NH2 | 1186 |
| 1369 | Ac-WQAWIEYERLLVQAKLKIAIAKLYIAKELLEWAWF-NH2 | 1187 |
| 1370 | Ac-WQAWIEYERLLVQVKLKIAIALLYIAKELLEWAWF-NH2 | 1188 |
| 1371 | Ac-WQAWIELERLLVQVKLKLAIAKLEIAKELLEWAWF-NH2 | 1189 |
| 1372 | Ac-GEWTYDDATKTFTVTEGGH-NH2 | 1190 |
| 1373 | Ac-WQEWEQKIGEWTYDDATKTFTVTEGGHWASLWEWF-NH2 | 1191 |
| 1374 | Ac-GEWTYDDATKTFTVTE-NH2 | 1192 |
| 1375 | Ac-WQEWEQKIGEWTYDDATKTFTVTEWASLWEWF-NH2 | 1193 |
| 1376 | Ac-MHRFDYRT-NH2 | 1194 |
| 1377 | Ac-WQEWEQKIMHRFDYRTWASLWEWF-NH2 | 1195 |
| 1378 | Ac-MHRFNWSTGGG-NH2 | 1196 |
| 1379 | Ac-WQEWEQKIMHRFNWSTGGGWASLWEWF-NH2 | 1197 |
| 1380 | Ac-MHRFNWST-NH2 | 1198 |
| 1381 | Ac-WQEWEQKIMHRFNWSTWASLWEWF-NH2 | 1199 |
| 1382 | Ac-LLVPLARIMTMSSVHGGG-NH2 | 1200 |
| 1383 | Ac-WQEWEQKILLVPLARIMTMSSVHGGGWASLWEWF-NH2 | 1201 |
| 1384 | Ac-LLVPLARIMTMSSVH-NH2 | 1202 |
| 1385 | Ac-WQEWEQKILLVPLARIMTMSSVHWASLWEWF-NH2 | 1203 |
| 1386 | TALLEQAQIQQEKNEYELQKLDK | 1204 |
| 1387 | Ac-TALLEQAQIQQEKNEYELQKLDK-NH2 | 1205 |
| 1388 | Ac-TALLEQAQIQQEKIEYELQKLIE-NH2 | 1206 |
| 1389 | TALLEQAQIQQEKIEYELQKLIE | 1207 |
| 1390 | Ac-QARQLLSGIVQQQNNLLRAIEAQQHLLQLTVWGIKQLQARILAVERY-NH2 | 1208 |
| 1391 | Rhod-QARQLLSGIVQQQNNLLRAIEAQQHLLQLTVWGIKQLQARILAVERY-NH2 | 1209 |
| 1392 | Ac-GAASLTLSAQSRTLLAGIVQQQQQLLDVVKRQQEML-NH2 | 1210 |
| 1393 | Ac-GSAMGAASLTLSAQSRTLLAGIVQQQQQLLDVVKRQQEML-NH2 | 1211 |
| 1394 | Ac-PALSTGLIHLHQNIVDVQFLFGVGSSIASWAIKWEY-NH2 | 1212 |
| 1395 | Ac-PALSTGLIHLHQNIVDVQFLYGVGSSIASWAIK-NH2 | 1213 |
| 1396 | Ac-LSTTQWQVLPUSFTTLPALSTGLIHLHQNIVDVQY-NH2 | 1561 |
| 1397 | Ac-FRKFPEATFSRUGSGPRITPRUMVDFPFRLWHY-NH2 | 1562 |
| 1398 | Ac-DFPFRLWHFPUTINYTIFKVRLFVGGVEHRLEAAUNWTR-NH2 ♂ | 1563 |
| 1399 | Ac-YVGGVEHRLEAAUNWTRGERUDLEDRDRSELSPL-NH2 | 1564 |
| 1400 | MVYPSDEYDASISQVNEEINQALAYIRKADELLENV | 1218 |
| 1402 | Ac-GPLLVLQAGFFLLTRILTIPQSLDSWWTSLNFLGG-NH2 | 1220 |
| 1403 | Ac-LGPLLVLQAGFFLLTRILTIPQSLDSWWTSLNFLG-NH2 | 1221 |
| 1404 | Ac-FLGPLLVLQAGFFLLTRILTIPQSLDSWWTSLNFL-NH2 | 1222 |
| 1405 | Ac-YTNTIYTLLEESQNQQEKNEQELLELDKWASLWNWF-NH2 | 1357 |
| 1406 | YTNTIYTLLEESQNQQEKNEQELLELDKWASLWNWF | 1357 |
| 1407 | Ac-YTGIIYNLLEESQNQQEKNEQELLELDKWANLWNWF-NH2 | 1358 |
| 1408 | YTGIIYNLLEESQNQQEKNEQELLELDKWANLWNWF | 1359 |
| 1409 | Ac-YTSLIYSLLEKSQIQQEKNEQELLELDKWASLWNWF-NH2 | 1360 |
| 1410 | YTSLIYSLLEKSQIQQEKNEQELLELDKWASLWNWF | 1360 |
| 1411 | Ac-EKSQIQQEKNEQELLELDKWA-NH2 | 1362 |
| 1412 | EKSQIQQEKNEQELLELDKWA | 1362 |
| 1413 | Ac-EQAQIQQEKNEYELQKLDKWA-NH2 | 1364 |
| 1414 | Ac-YTSLIGSLIEESQIQQERNEQELLELDRWASLWEWF-NH2 | 1223 |
| 1415 | Ac-YTXLIHSLIXESQNQQXKNEQELXELDKWASLWNWF-NH2 | 1366 |

TABLE 1-continued

| T No. | Sequence | Seq. ID No. |
|---|---|---|
| 1416 | Ac-YTXLIHSLIWESQNQQXKNEQELXELD-NH2 | 1565 |
| 1417 | Ac-YTSLIHSLIEESQNQQEKNEQELLELD-NH2 | 1368 |
| 1418 | Ac-WQEQEXKITALLXQAQIQQXKNEYELXKLDKWASLWEWF-NH2 | 1566 |
| 1419 | Ac-XKITALLXQAQIQQXKNEYELXKLDKWASLWEWF-NH2 | 1370 |
| 1420 | Ac-WQEWWXKITALLXQAQIQQXKNEYELXKLD-NH2 | 1567 |
| 1421 | Ac-WEQKITALLEQAQIQQEKNEYELQKLD-NH2 | 1372 |
| 1422 | Ac-WEXKITALLXQAQIQQXKNEYELXKLD-NH2 | 1568 |
| 1423 | Ac-XKITALLXQAQIQQXKNEYELXKLD-NH2 | 1374 |
| 1425 | Ac-QKITALLEQAQIQQEKNEYELQKLD-NH2 | 1375 |
| 1426 | Ac-QKITALLEQAQIQQEKNEYELQKLDKWASLWEWF-NH2 | 1381 |
| 1427 | Ac-WQEWEQKITALLEQAQIQQEKNEYELQKLD-NH2 | 1379 |
| 1428 | Ac-VYPSDEYDASISQVNEEINQALAYIRKADELLEN-OH | 1237 |
| 1429 | Ac-VYPSDEYDASISQVNEEINQALAYIRKADELLE-OH | 1237 |
| 1430 | Ac-VYPSDEYDASISQVNEEINQALAYIRKADELL-OH | 1376 |
| 1431 | Ac-VYPSDEYDASISQVNEEINQALAYIRKADEL-OH | 1378 |
| 1432 | YPSDEYDASISQVNEEINQALAYIRKADELLENV-NH2 | 1227 |
| 1433 | PSDEYDASISQVNEEINQALAYIRKADELLENV-NH2 | 1228 |
| 1434 | SDEYDASISQVNEEINQALAYIRKADELLENV-NH2 | 1229 |
| 1435 | DEYDASISQVNEEINQALAYIRKADELLENV-NH2 | 1230 |
| 1436 | Ac-VYPSDEYDASISQVDEEINQALAYIRKADELLENV-NH2 | 1231 |
| 1437 | Ac-VYPSDEYDASISQVNEEIDQALAYIRKADELLENV-NH2 | 1232 |
| 1438 | Ac-VYPSDEYDASISQVNEEINQALAYIRKADELLEDV-NH2 | 1233 |
| 1439 | Ac-VYPSDEYDASISQVDEEIDQALAYIRKADELLENV-NH2 | 1234 |
| 1440 | Ac-LLSTNKAVVSLSNGVSVLTSKVLDLKNYIDKQLLP-NH2 | 1235 |
| 1441 | Ac-LSTNKAVVSLSNGVSVLTSKVLDLKNYIDKQLLPI-NH2 | 1236 |
| 1442 | Ac-STNKAVVSLSNGVSVLTSKVLDLKNYIDKQLLPIV-NH2 | 1382 |
| 1443 | Ac-TNKAVVSLSNGVSVLTSKVLDLKNYIDKQLLPIVN-NH2 | 1383 |
| 1444 | Ac-NKAVVSLSNGVSVLTSKVLDLKNYIDKQLLPIVNK-NH2 | 1384 |
| 1445 | Ac-KAVVSLSNGVSVLTSKVLDLKNYIDKQLLPIVNKQ-NH2 | 1385 |
| 1446 | Ac-AVVSLSNGVSVLTSKVLDLKNYIDKQLLPIVNKQS-NH2 | 1155 |
| 1447 | Ac-VVSLSNGVSVLTSKVLDLKNYIDKQWLLPIVNKQSU-NH2 | 1570 |
| 1448 | Ac-VSLSNGVSVLTSKVLDLKNYIDKQLLPIVNKQSUS-NH2 | 1571 |
| 1449 | Ac-SLSNGVSVLTSKVLDLKNYIDKQLLPIVNKQSUSI-NH2 | 1572 |
| 1450 | Ac-LSNGVSVLTSKVLDLKNYIDKQLLPIVNKQSUSIS-NH2 | 1573 |
| 1451 | Ac-SNGVSVLTSKVLDLKNYIDKQLLPIVNKQSUSISN-NH2 | 1574 |
| 1452 | Ac-NGVSVLTSKVLDLKNYIDKQLLPIVNKQSUSISNI-NH2 | 1575 |
| 1453 | Ac-GVSVLTSKVLDLKNYIDKQLLPIVNKQSUSISNIE-NH2 | 1576 |
| 1454 | Ac-VSVLTSKVLDLKNYIDKQLLPIVNKQSUSISNIET-NH2 | 1577 |
| 1455 | Ac-SVLTSKVLDLKNYIDKQLLPIVNKQSUSISNIETV-NH2 | 1578 |
| 1456 | Ac-VLTSKVLDLKNYIDKQLLPIVNKQSUSISNIETVI-NH2 | 1579 |
| 1457 | Ac-LTSKVLDLKNYIDKQLLPIVNKQSUSISNIETVIE-NH2 | 1580 |
| 1458 | Ac-TSKVLDLKNYIDKQLLPIVNKQSUSISNIETVIEF-NH2 | 1581 |
| 1459 | Ac-SKVLDLKNYIDKQLLPIVNKQSUSISNIETVIEFQ-NH2 | 1582 |
| 1460 | Ac-KVLDLKNYIDKQLLPIVNKQSUSISNIETVIEFQQ-NH2 | 1583 |
| 1461 | Ac-VLDLKNYIDKQLLPIVNKQSUSISNIETVIEFQQK-NH2 | 1584 |
| 1462 | Ac-LDLKNYIDKQLLPIVNKQSUSISNIETVIEFQQKN-NH2 | 1585 |
| 1463 | Ac-DLKNYIDKQLLPIVNKQSUSISNIETVIEFQQKNN-NH2 | 1586 |
| 1464 | Ac-LKNYIDKQLLPIVNKQSUSISNIETVIEFQQKNNR-NH2 | 1587 |
| 1465 | Ac-KNYIDKQLLPIVNKQSUSISNIETVIEFQQKNNRL-NH2 | 1588 |
| 1466 | Ac-NYIDKQLLPIVNKQSUSISNIETVIEFQQKNNRLL-NH2 | 1589 |
| 1467 | Ac-YIDKQLLPIVNKQSUSISNIETVIEFQQKNNRLLE-NH2 | 1590 |
| 1468 | Ac-IDKQLLPIVNKQSUSISNIETVIEFQQKNNRLLEI-NH2 | 1591 |
| 1469 | Ac-DKQLLPIVNKQSUSISNIETVIEFQQKNNRLLEIT-NH2 | 1592 |
| 1470 | Ac-KQLLPIVNKQSUSISNIETVIEFQQKNNRLLEITR-NH2 | 1593 |
| 1471 | Ac-QLLPIVNKQSUSISNIETVIEFQQKNNRLLEITRE-NH2 | 1594 |
| 1472 | Ac-VYPSDEYDASISQVNEEINQALA | 1412 |
| 1473 | QVNEEINQALAYIRKADELLENV-NH2 | 1413 |
| 1474 | VYPSDEYDASISQVNEEINQALAYIRKADELLENV | 1414 |
| 1475 | Ac-DEYDASISQVNEEINQALAYIREADEL-NH2 | 1415 |
| 1476 | Ac-DEYDASISQVNEKINQALAYIREADEL-NH2 | 1416 |
| 1477 | Ac-DDECLNSVKNGTYDFPKFEEESKLNRNEIKGVKLS-NH2 | 1417 |
| 1478 | Ac-DDE-Abu-LNSVKNGTYDFPKFEEESKLNRNEIKGVKLS-NH2 | 1595 |
| 1479 | Ac-YHKCDDECLNSVKNGTFDFPKFEEESKLNRNEIKGVKLSS-NH2 | 1596 |
| 1480 | Ac-YHK-Abu-DDE-Abu-LNSVKNGTFDFPKFEEESKLNRNEIKGVKLSS-NH2 | 1597 |
| 1481 | Ac-YTSLIHSLIEESQIQQEKNEQELLELDKWASLWNWF-NH2 | 1598 |
| 1482 | Ac-YTSLIHSLIEESQNQQEKNEYELLELDKWASLWNWF-NH2 | 1599 |
| 1483 | Ac-YTSLIHSLIEESQIQQEKNEYELLELDKWASLWNWF-NH2 | 1600 |
| 1484 | Ac-YTSLIHSLIEESQIQQEKNEYELQKLDKWASLWNWF-NH2 | 1244 |
| 1485 | Ac-YTSLIHSLIEESQNQQEKNEQELQKLDKWASLWNWF-NH2 | 1245 |
| 1486 | Ac-YTSLIHSLIEESQNQQEKNEYELQKLDKWASLWNWF-NH2 | 1421 |
| 1487 | Ac-YTSLIHSLIEESQIQQEKNEQELQKLDKWASLWNWF-NH2 | 1422 |
| 1488 | Ac-YTSLIHSLIEESQNQQEKNEQELLELDKWASLWEWF-NH2 | 1423 |
| 1489 | Ac-YTSLIHSLIEESQIQQEKNEQELLELDKWASLWEWF-NH2 | 1424 |
| 1490 | Ac-YTSLIHSLIEESQNQQEKNEYELLELDKWASLWEWF-NH2 | 1425 |
| 1491 | Ac-YTSLIHSLIEESQIQQEKNEYELLELDKWASLWEWF-NH2 | 1426 |
| 1492 | Ac-YTSLIHSLIEESQIQQEKNEYELQKLDKWASLWEWF-NH2 | 1601 |

TABLE 1-continued

| T No. | Sequence | Seq. ID No. |
|---|---|---|
| 1493 | Ac-YTSLIHSLIEESQNQQEKNEQELQKLDKWASLWEWF-NH2 | 1428 |
| 1494 | Ac-YTSLIHSLIEESQNQQEKNEYELQKLDKWASLWEWF-NH2 | 1429 |
| 1495 | Ac-YTSLIHSLIEESQIQQEKNEQELQKLDKWASLWEWF-NH2 | 1430 |
| 1496 | Ac-WQEWEQKITALLEQAQIQQEKNEYELQKLDKEWWF-NH2 | 1602 |
| 1497 | Ac-WQEWEQKITALLEQAQIQQEKNEYELQKLIEWASLWEWF-NH2 | 1432 |
| 1498 | Ac-WQEWEQKITALLEQAQIQQEKNEYELQKLAKWASLWEWF-NH2 | 1256 |
| 1499 | Ac-WQEWEQKITALLEQAQIQQEKNEYELQKLIKWASLWEWF-NH2 | 1257 |
| 1500 | Ac-WQEWEQKITALLEQAQIQQEKNEYELQKLIEWAGLWEWF-NH2 | 1258 |
| 1501 | Ac-WQEWEQKITALLEQAQIQQEKNEYELQKLAKWAGLWEWF-NH2 | 1260 |
| 1502 | Ac-WQEWEQKITALLEQAQIQQEKNEYELQKLIKWAGLWEWF-NH2 | 1259 |
| 1503 | Ac-WQEWEQKITALLEQAQIQQEKNEYELQKLIEWAGLWAWF-NH2 | 1261 |
| 1504 | Ac-WQEWEQKITALLEQAQIQQEKNEYELQKLAKWAGLWAWF-NH2 | 1262 |
| 1505 | Ac-WQEWEQKITALLEQAQIQQEKNEYELQKLIKWAGLWAWF-NH2 | 1263 |
| 1506 | Ac-WQEWEQKITALLEQAQIQQEKGEYELQKLDKQEQF-NH2 | 1267 |
| 1507 | Ac-WQEWEQKITALLEQAQIQQEKGEYELLELDKWEWF-NH2 | 1265 |
| 1508 | Ac-WQEWEQKITALLEQAQIQQEKGEYELQKLAKWEWF-NH2 | 1266 |
| 1509 | Ac-WQEWEQKITALLEQAQIQQEKGEYELQKLDWQWEF-NH2 | 1603 |
| 1510 | Ac-WQEWEQKITALLEQAQIQQEKGEYELLELAKWEWF-NH2 | 1268 |
| 1511 | Ac-WEQWEQKITALLEQAQIQQEKNEYELLELDKWEWF-NH2 | 1604 |
| 1512 | Ac-WQEWEQKITALLEQAQIQQEKNEYELEEELIEWASLWEWF-NH2 | 1605 |
| 1513 | Ac-WQEWEQKITALLEQAQIQQEKNEYELLELIEWAGLWEWF-NH2 | 1271 |
| 1514 | Ac-WQEWEQKITALLEQAQIQQEKNEYELLELIEWAGLWAWF-NH2 | 1272 |
| 1515 | Ac-WQEWEREITALLEQAQIQQEKNEYELQKLIEWASLWEWF-NH2 | 1273 |
| 1516 | Ac-WQEWEREIQQEKNEYELQKLDKWASLWEWF-NH2 | 1274 |
| 1517 | Ac-WQEWEREIQQEKGEYELQKLIEWEWF-NH2 | 1275 |
| 1518 | Ac-WQEWQAQIQQEKNEYELQKLDKWASLWEWF-NH2 | 1606 |
| 1519 | Ac-WQEWQAQIQQEKGEYELQKLIEWEWF-NH2 | 1277 |

It is to be understood that such core polypeptide sequences, per se, can exhibit antiviral and/or anti-fusogenic activity and are considered part of the present invention. Among the core polypeptide sequences are, for example, ones which have been derived from individual viral protein sequences. Also among the core polypeptide sequences are, for example, ones whose amino acid sequences are derived from greater than one viral protein sequence (e.g., an HIV-1, HIV-2 and SIV -derived core polypeptide).

The amino- and carboxy-termini of such core polypeptides (either per se or as part of a hybrid polypeptide) can be as discussed above for hybrid polypeptides. It is noted that while a number of the core polypeptides listed in Table 1, above, are depicted with modified, e.g., blocked amino and/or carboxy termini, that any core polypeptide comprising an unmodified primary amino acid sequence as depicted in Table 1 are to also be considered part of the present invention.

In addition, such core polypeptides can exhibit amino acid substitutions, deletions and/or insertions as discussed, above, for enhancer polypeptide sequences as long as the particular core polypeptide's antiviral and/or antifusogenic activity (either per se or as part of a hybrid polypeptide) is not abolished. With respect to amino acid deletions, it is preferable that the resulting core polypeptide is at least about 4–6 amino acid residues in length. With respect to amino acid insertions, preferable insertions are no greater than about 50 amino acid residues, and, more preferably no more than about 15 amino acid residues. It is also preferable that core polypeptide insertions be amino- and/or carboxy-terminal insertions.

Among such amino and/or carboxy-terminal insertions are ones which comprise amino acid sequences amino and/or carboxy to the endogenous protein sequence from which the core polypeptide is derived. For example, if the core polypeptide is derived from gp41 protein, such an insertion would comprise an amino and/or carboxy-terminal insertion comprising a gp41 amino acid sequence adjacent to the gp41 core polypeptide sequence.

The invention further relates to the association of the enhancer core polypeptide sequences to types of molecules other than peptides. For example, the enhancer peptide sequences may be linked to nucleic acid molecules (e.g., DNA or RNA) or any type of small organic molecule for the purpose of enhancing the pharmacokinetic properties of said molecules.

5.2. SYNTHESIS OF PEPTIDES

The enhancer, core and hybrid polypeptides of the invention may be synthesized or prepared by techniques well known in the art. See, for example, Creighton, 1983, Proteins: Structures and Molecular Principles, W. H. Freeman and Co., NY, which is incorporated herein by reference in its entirety. Hybrid polypeptides may be prepared using conventional step-wise solution or solid phase synthesis, fragment condensation, F-MOC or T-BOC chemistry. (see, e.g., Chemical Approaches to the Synthesis of Peptides and Proteins, Williams et al., Eds., 1997, CRC Press, Boca Raton Fla., and references cited therein; Solid Phase Peptide Synthesis: A Practical Approach, Atherton & Sheppard, Eds., 1989, IRL Press, Oxford, England, and references cited therein). Likewise the amino- and/or carboxy-terminal modifications.

The enhancer, core and hybrid polypeptides of the invention can be purified by art-known techniques such as normal and reverse phase high performance liquid chromatography, ion exchange chromatography, gel electrophoresis, affinity chromatography, size exclusion, precipitation and the like. The actual conditions used to purify a particular polypeptide will depend, in part, on synthesis strategy and on factors such as net charge, hydrophobicity, hydrophilicity, solubility, stability etc., and will be apparent to those having skill in the art.

Hybrid, enhancer and core polypeptides may also be made using recombinant DNA techniques. Here, the nucleotide sequences encoding the polypeptides of the invention may be synthesized, and/or cloned, and expressed according to techniques well known to those of ordinary skill in the art. See, for example, Sambrook, et al., 1989, Molecular Cloning, A Laboratory Manual, Vols. 1–3, Cold Spring Harbor Press, NY.

One may obtain the DNA segment encoding the polypeptide of interest using a variety of molecular biological techniques, generally known to those skilled in the art. For example, polymerase chain reaction (PCR) may be used to generate the DNA fragment encoding the protein of interest. Alternatively, the DNA fragment may be obtained from a commercial source.

The DNA encoding the polypeptides of interest may be recombinantly engineered into a variety of host vector systems that also provide for replication of the DNA in large scale. These vectors can be designed to contain the necessary elements for directing the transcription and/or translation of the DNA sequence encoding the hybrid polypeptide.

Vectors that may be used include, but are not limited to, those derived from recombinant bacteriophage DNA, plasmid DNA or cosmid DNA. For example, plasmid vectors such as pcDNA3, pBR322, pUC 19/18, pUC 118, 119 and the M13 mp series of vectors may be used. Bacteriophage vectors may include λgt10, λgt11, λgt18–23, λZAP/R and the EMBL series of bacteriophage vectors. Cosmid vectors that may be utilized include, but are not limited to, pJB8, pCV 103, pCV 107, pCV 108, pTM, PMCS, pNNL, pHSG274, COS202, COS203, pWE15, pWE16 and the charomid 9 series of vectors.

Alternatively, recombinant virus vectors including, but not limited to, those derived from viruses such as herpes virus, retroviruses, vaccinia viruses, adenoviruses, adeno-associated viruses or bovine papilloma viruses plant viruses, such as tobacco mosaic virus and baculovirus may be engineered.

In order to express a biologically active polypeptide, the nucleotide sequence coding for the protein may be inserted into an appropriate expression vector, i.e., a vector which contains the necessary elements for the transcription and translation of the inserted coding sequences. Methods which are well known to those skilled in the art can be used to construct expression vectors having the hybrid polypeptide coding sequence operatively associated with appropriate transcriptional/translational control signals. These methods include in vitro recombinant DNA techniques and synthetic techniques. See, for example, the techniques described in Sambrook, et al., 1992, Molecular Cloning, A Laboratory Manual, Cold Spring Harbor Laboratory, N.Y. and Ausubel et al., 1989, Current Protocols in Molecular Biology, Greene Publishing Associates & Wiley Interscience, N.Y., each of which are incorporated herein by reference in its entirety.

The nucleic acid molecule encoding the hybrid, enhancer and core polypeptides of interest may be operatively associated with a variety of different promoter/enhancer elements. The promoter/enhancer elements may be selected to optimize for the expression of therapeutic amounts of protein. The expression elements of these vectors may vary in their strength and specificities. Depending on the host/vector system utilized, any one of a number of suitable transcription and translation elements may be used. The promoter may be in the form of the promoter which is naturally associated with the gene of interest. Alternatively, the DNA may be positioned under the control of a recombinant or heterologous promoter, i.e., a promoter that is not normally associated with that gene. For example, tissue specific promoter/enhancer elements may be used to regulate the expression of the transferred DNA in specific cell types.

Examples of transcriptional control regions that exhibit tissue specificity which have been described and could be used include, but are not limited to, elastase I gene control region which is active in pancreatic acinar cells (Swift et al., 1984, *Cell* 38:639–646; Ornitz et al., 1986, *Cold Spring Harbor Symp. Quant. Biol.* 50:399–409; MacDonald, 1987, *Hepatology* 7:42S–51S); insulin gene control region which is active in pancreatic beta cells (Hanahan, 1985, *Nature* 315:115–122); immunoglobulin gene control region which is active in lymphoid cells (Grosschedl et al., 1984, *Cell* 38:647–658; Adams et al., 1985, *Nature* 318:533–538; Alexander et al., 1987, *Mol. Cell. Biol.* 7:1436–1444): albumin gene control region which is active in liver (Pinkert et al., 1987, *Genes and Devel.* 1:268–276) alpha-fetoprotein gene control region which is active in liver (Krumlauf et al., 1985, *Mol. Cell. Biol.* 5:1639–1648; Hammer et al., 1987, *Science* 235:53–58); alpha-1-antitrypsin gene control region which is active in liver (Kelsey et al., 1987, *Genes and Devel.* 1:161–171); beta-globin gene control region which is active in myeloid cells (Magram et al., 1985, *Nature* 315:338–340; Kollias et al., 1986, *Cell* 46:89–94); myelin basic protein gene control region which is active in oligodendrocyte cells in the brain (Readhead et al., 1987, *Cell* 48:703–712); myosin light chain-2 gene control region which is active in skeletal muscle (Shani, 1985, *Nature* 314:283–286); and gonadotropic releasing hormone gene control region which is active in the hypothalamus (Mason et al., 1986, *Science* 234:1372–1378). Promoters isolated from the genome of viruses that grow in mammalian cells, (e.g., vaccinia virus 7.5K, SV40, HSV, adenoviruses MLP, MMTV, LTR and CMV promoters) may be used, as well as promoters produced by recombinant DNA or synthetic techniques.

In some instances, the promoter elements may be constitutive or inducible promoters and can be used under the appropriate conditions to direct high level or regulated expression of the nucleotide sequence of interest. Expression of genes under the control of constitutive promoters does not require the presence of a specific substrate to induce gene expression and will occur under all conditions of cell growth. In contrast, expression of genes controlled by inducible promoters is responsive to the presence or absence of an inducing agent.

Specific initiation signals are also required for sufficient translation of inserted protein coding sequences. These signals include the ATG initiation codon and adjacent sequences. In cases where the entire coding sequence, including the initiation codon and adjacent sequences are inserted into the appropriate expression vectors, no additional translational control signals may be needed. However, in cases where only a portion of the coding sequence is inserted, exogenous translational control signals, including the ATG initiation codon must be provided. Furthermore, the initiation codon must be in phase with the reading frame of the protein coding sequences to ensure translation of the entire insert. These exogenous translational control signals and initiation codons can be of a variety of origins, both natural and synthetic. The efficiency of expression may be enhanced by the inclusion of transcription attenuation sequences, enhancer elements, etc.

5.3. PHARMACEUTICAL FORMULATIONS, DOSAGES AND MODES OF ADMINISTRATION

The peptides of the invention may be administered using techniques well known to those in the art. Preferably, agents are formulated and administered systemically. Techniques for formulation and administration may be found in "Remington's Pharmaceutical Sciences", 18th ed., 1990, Mack Publishing Co., Easton, Pa. Suitable routes may include oral, rectal, vaginal, lung, transdermal, transmucosal, or intestinal administration; parenteral delivery, including intramuscular, subcutaneous, intramedullary injections, as well as, intrathecal, direct intraventricular, intravenous, intraperitoneal, intranasal, or intraocular injections, just to name a few. For intravenous injection, the agents of the invention may be formulated in aqueous solutions, preferably in physiologically compatible buffers such as Hanks' solution, Ringer's solution, or physiological saline buffer to name a few. In addition, infusion pumps may be used to deliver the peptides of the invention. For such transmucosal administration, penetrants appropriate to the barrier to be permeated are used in the formulation. Such penetrants are generally known in the art.

In instances wherein intracellular administration of the peptides of the invention or other inhibitory agents is preferred, techniques well known to those of ordinary skill in the art may be utilized. For example, such agents may be encapsulated into liposomes, or microspheres then administered as described above. Liposomes are spherical lipid bilayers with aqueous interiors. All molecules present in an aqueous solution at the time of liposome formation are incorporated into the aqueous interior. The liposomal contents are both protected from the external microenvironment and, because liposomes fuse with cell membranes, are effectively delivered into the cell cytoplasm. Additionally, due to their hydrophobicity, when small molecules are to be administered, direct intracellular administration may be achieved.

Nucleotide sequences encoding the peptides of the invention which are to be intracellularly administered may be expressed in cells of interest, using techniques well known to those of skill in the art. For example, expression vectors derived from viruses such as retroviruses, vaccinia viruses, adeno-associated viruses, herpes viruses, or bovine papilloma viruses, may be used for delivery and expression of such nucleotide sequences into the targeted cell population. Methods for the construction of such vectors and expression constructs are well known. See, for example, Sambrook et al., 1989, Molecular Cloning, A Laboratory Manual, Cold Spring Harbor Press, Cold Spring Harbor NY, and Ausubel et al., 1989, Current Protocols in Molecular Biology, Greene Publishing Associates and Wiley Interscience, NY.

Effective dosages of the peptides of the invention to be administered may be determined through procedures well known to those in the art which address such parameters as biological half-life, bioavailability, and toxicity. In one embodiment, an effective hybrid polypeptide dosage range is from 0.1–100 µg/kg body weight. A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit large therapeutic indices are preferred. The data obtained from these cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (e.g., the concentration of the test compound which achieves a half-maximal inhibition of the fusogenic event, such as a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC) or any biological or immunological assay capable of measuring peptide levels.

The hybrid polypepties of the invention can also be administered in combination with at least one other therapeutic agent. Administration can be concomitantly or sequentially, including cycling therapy (that is, administration of a first compound for a period of time, followed by administration of a second antiviral compound for a period of time and repeating this sequential administration in order to reduce the development of resistance to one of the therapies).

In the case of viral infections, an effective amount of a hybrid polypeptide or a pharmaceutically acceptable derivative thereof can be administered in combination with at least one other antiviral agent. Such antiviral agents can include, but are not limited to DP-107, DP-178, cytokines, e.g., rIFN α, rIFN β, rIFN γ; inhibitors of reverse transcriptase, e.g., AZT, 3TC, D4T, ddI, and other dideoxynucleosidesor dideoxyfluoronucleosides; inhibitors of viral mRNA capping, such as ribavirin; inhibitors of HIV protease, such as ABT-538 and MK-639; amphotericin B as a lipid-binding molecule with anti-HIV activity; and castanospermine as an inhibitor of glycoprotein processing.

The hybrid and/or core polypeptides of the invention may, further, be utilized prophylactically for the prevention of disease. Hybrid and/or core polypeptides can act directly to prevent disease or, alternatively, can be used as vaccines, wherein the host raises antibodies against the hybrid polypeptides of the invention, which then serve to neutralize pathogenic organisms including, for example, inhibiting viral, bacterial and parasitic infection.

For all such treatments described above, the exact formulation, route of administration and dosage can be chosen by the individual physician in view of the patient's condition. (See e.g. Fingl et al., 1975, in "The Pharmacological Basis of Therapeutics", Ch. 1 p1).

It should be noted that the attending physician would know how to and when to terminate, interrupt, or adjust administration due to toxicity, or to organ dysfunctions. Conversely, the attending physician would also know to adjust treatment to higher levels if the clinical response were not adequate (precluding toxicity). The magnitude of an administrated dose in the management of the oncogenic disorder of interest will vary with the severity of the condition to be treated and the route of administration. The dose and perhaps dose frequency, will also vary according to the age, body weight, and response of the individual patient. A program comparable to that discussed above may be used in veterinary medicine.

Use of pharmaceutically acceptable carriers to formulate the compounds herein disclosed for the practice of the invention into dosages suitable for systemic administration is within the scope of the invention. With proper choice of carrier and suitable manufacturing practice, the compositions of the present invention, in particular, those formulated as solutions, may be administered parenterally, such as by intravenous injection. The compounds can be formulated readily using pharmaceutically acceptable carriers well known in the art into dosages suitable for oral administration. Such carriers enable the compounds of the invention to be formulated as tablets, pills, capsules, liquids, gels, syrups, slurries, suspensions and the like, for oral ingestion by a patient to be treated.

Pharmaceutical compositions suitable for use in the present invention include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of the active compounds into preparations which can be used pharmaceutically. The preparations formulated for oral administration may be in the form of tablets, dragees, capsules, or solutions.

The pharmaceutical compositions of the present invention may be manufactured in a manner that is itself known, e.g., by means of conventional mixing, dissolving, granulating, dragee-making, levigating, spray drying, emulsifying, encapsulating, entrapping or lyophilizing processes.

Pharmaceutical formulations for parenteral administration include aqueous solutions of the active compounds in water-soluble form. Additionally, emulsions and suspensions of the active compounds may be prepared as appropriate oily injection mixtures. Suitable lipophilic solvents or vehicles include fatty oils such as sesame oil, or synthetic fatty acid esters, such as ethyl oleate or triglycerides, liposomes or other substances known in the art for making lipid or lipoptilic emulsions. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Pharmaceutical preparations for oral use can be obtained by combining the active compounds with solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, trehalose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added.

In instances where an enhancement of the host immune response is desired, the hybrid polypeptides may be formulated with a suitable adjuvant in order to enhance the immunological response. Such adjuvants may include, but are not limited to mineral gels such as aluminum hydroxide; surface active substances such as lysolecithin, pluronic polyols, polyanions; other peptides; oil emulsions; and potentially useful human adjuvants such as BCG and Corynebacterium parvum. Many methods may be used to introduce the vaccine formulations described here. These methods include but are not limited to oral, intradermal, intramuscular, intraperitoneal, intravenous, subcutaneous, and intranasal routes.

6. EXAMPLE: IDENTIFICATION OF CONSENSUS AMINO ACID SEQUENCES THAT COMPRISE ENHANCER PEPTIDE SEQUENCES

Figures 2A, 2B:
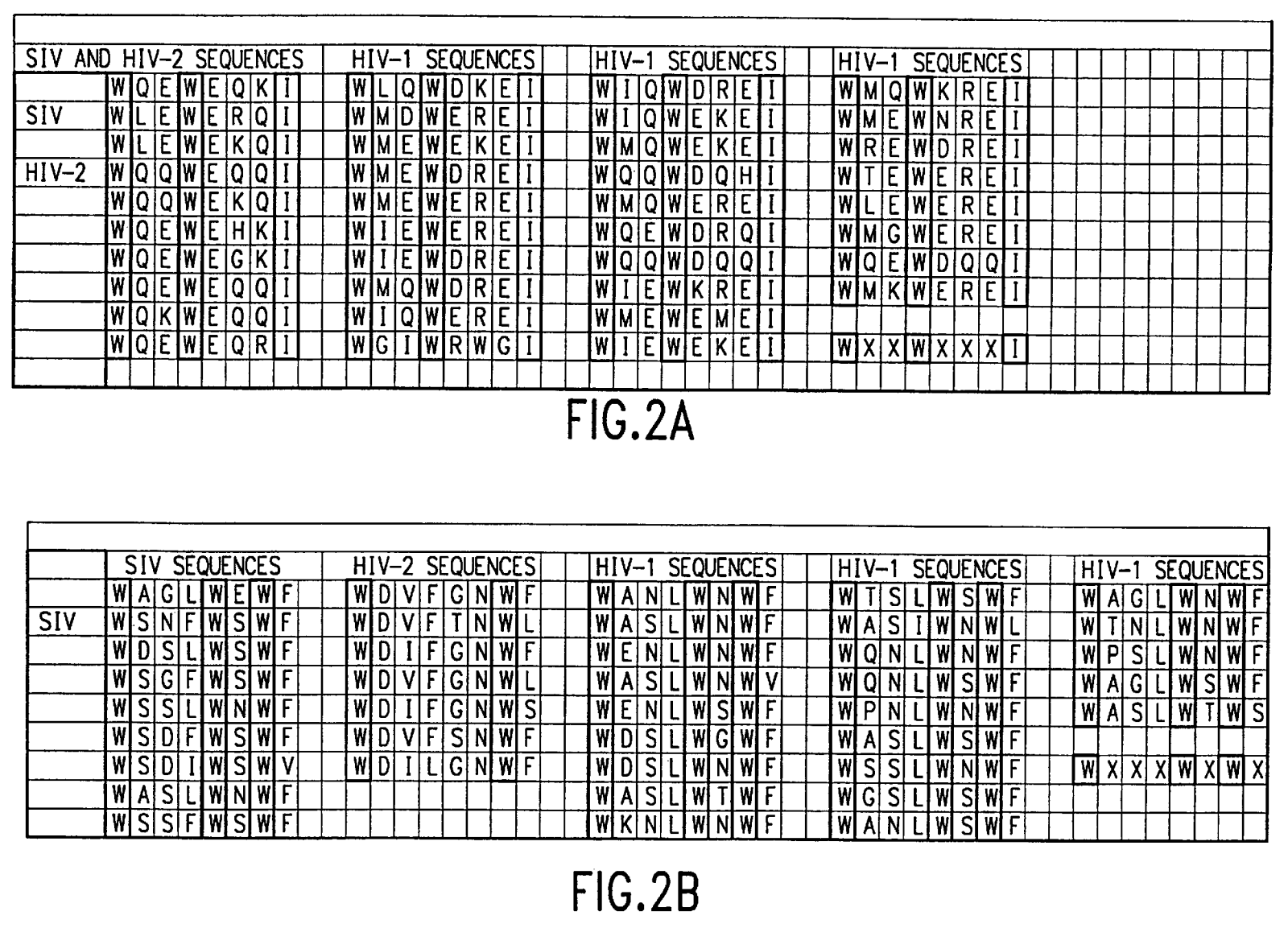

The retroviral gp41 protein contains structural domains referred to as the α-helix region located in the C-terminal region of the protein and the leucine zipper region located in the N-terminal region of the protein. Alignment of the enhancer sequence regions contained within gp41 (FIGS. 2A and 2B) of gp41 from all currently published isolate sequences of HIV-1, HIV-2 and SIV identified the consensus amino acid sequences shown in FIG. 1.

As described in detail in the Examples presented below, such sequences represent enhancer peptide sequences in that linkage of these peptide sequences to a variety of different core polypeptides enhances the pharmacokinetic properties of the resultant hybrid polypeptides.

7. EXAMPLE: HYBRID POLYPEPTIDES THAT FUNCTION AS POTENT INHIBITORS OF HIV-1 INFECTION

T1249, as depicted in FIGS. 13A–D, is a hybrid polypeptide comprising enhancer peptide sequences linked to an HIV core polypeptide. As demonstrated below, the T1249 hybrid polypeptide exhibits enhanced pharmacokinetic properties and potent in vitro activity against HIV-1, HIV-2, and SIV isolates, with enhanced activity against HIV-1 clinical isolates in HuPBMC infectivity assays in vitro as well as in the HuPBMC SCID mouse model of HIV- 1 infection in vivo. In the biological assays described below, the activity of the T1249 is compared to the potent anti-viral T20 polypeptide. The T20 polypeptide, also known as DP-178, is derived from HIV-1 gp41 protein sequence, and is disclosed and claimed in U.S. Pat. No. 5,464,933.

7.1. MATERIALS AND METHODS

7.1.1. PEPTIDE SYNTHESIS AND PURIFICATION

Peptides were synthesized using Fast Moc chemistry. Generally, unless otherwise noted, the peptides contained amidated carboxyl termini and acetylated amino termini. Purification was carried out by reverse phase HPLC.

T1249 (Ac-WQEWEQKITALLEQAQIQQEKNEYELQKLDKWAS LWEWF-NH2) (SEQ ID NO:1071) is a 39 amino acid peptide (MW=5036.7) composed entirely of naturally occurring amino acids and is blocked at the amino terminus by an acetyl group and the carboxyl terminus is blocked by an amido group to enhance stability. T1387 is a 23 amino acid peptide lacking enhancer peptide sequences (Ac-TALLEQAQIQQEKNEYELQKLDK-NH2) (SEQ ID NO:1205). Thus, T1387 represents the core polypeptide of the T1249 hybrid polypeptide. T1387 is blocked at its amino- and carboxy- termini in the same manner as T1 249.

In particular, T1249 was synthesized using standard solid-phase synthesis techniques. The identity of the principal peak in the HPLC trace was confirmed by mass spectroscopy to be T1249.

T1249 was readily purified by reverse phase chromatography on a 6-inch column packed with a C18, 10 micron, 120A support.

7.1.2. VIRUS

The HIV-1$_{LA1}$ virus (Popovic, M. et al., 1984, Science 224:497–508) was propagated in CEM cells cultured in RPMI 1640 containing 10% fetal calf serum. Supernatant from the infected CEM cells was passed through a 0.2 $\mu$m filter and the infectious titer estimated in a microinfectivity assay using the AA5 cell line to support virus replication. For this purpose, 20 $\mu$l of serially diluted virus was added to 20 $\mu$l CEM cells at a concentration of 6×10$^5$/ml in a 96-well microtitre plate. Each virus dilution was tested in triplicate. Cells were cultured for seven days by addition of fresh medium every other day. On day 7 post infection, supernatant samples were tested for virus replication as evidenced by reverse transcriptase activity released to the supernatant. The TCID$_{50}$ was calculated according to the Reed and Muench formula (Reed, L. J. et al., 1938, Am. J. Hyg. 27:493–497).

7.1.3. CELL FUSION ASSAY

Approximately 7×10$^4$ Molt-4 cells were incubated with 1×10$^4$ CEM cells chronically infected with the HIV-1$_{LA1}$ virus in 96-well tissue culture plates in a final volume of 100 $\mu$l culture medium (RPM1 1640 containing 10% heat inactivated FBS, supplemented with 1% L-glutamine and 1% Pen-Strep) as previously described (Matthews, T. J. et al., 1987, Proc. Natl. Acad. Sci. USA 84: 5424–5428). Peptide inhibitors were added in a volume of 10 $\mu$l and the cell mixtures were incubated for 24 hr. at 37° C. in 5% CO$_2$. At that time, multinucleated giant cells (syncytia, five cell widths or larger) were counted by microscopic examination at 10× and 40× magnification which allowed visualization of the entire well in a single field. Treated cells were compared to infected, untreated controls and results expressed as percent inhibition of infected controls.

7.1.4. MAGI-CCR-5 INFECTIVITY ASSAYS

Approximately. 1×10$^6$ Magi-CCR-5 cells (obtained through the NIH AIDS Research and Reference Reagent Program, Division of AIDS, NIAID; Chackerian, B. et al., 1997, J. Virol. 71: 3932–3939) were seeded into a 48-well tissue culture plate (approximately 2×10$^4$ cells/well in a volume of 300 $\mu$l/well selective growth medium consisting of DMEM supplemented with 10% heat inactivated FBS, 1% L-glutamine, 1% Pen/Strep, Hygromycin B, Geneticin, and Puromycin) and allowed to attach overnight at 37° C., 5% CO$_2$. Cell confluency was approximately 30% by the following day. Seeding medium was removed and diluted peptide inhibitor added in volumes of 50 $\mu$l/well (media only in untreated controls), followed by 100 $\mu$l/well of diluted virus (desired input virus titre of 100–200 pfu/well). Finally, 250 $\mu$l of selective growth medium was added to each well and the plate incubated for 2 days at 37° C., 5% CO$_2$. Fixing and staining were done according to the protocol provided by NIAID with the MAGI-CCR5 cells. Briefly, medium was removed from the plate and 500 $\mu$l of fixative added to each well. Plates were allowed to fix for 5 minutes at room temp. Fixative was removed, each well washed twice with DPBS, and 200 $\mu$l of staining solution added to each well. The plate was then incubated at 37° C., 5% CO$_2$, for 50 minutes, staining solution removed, and each well washed twice with DPBS. The plate was allowed to air dry before blue cells were counted by microscopic, enumerating the entire well. Treated wells were compared to infected, untreated controls and results expressed as percent inhibition of infected controls.

7.1.5. REVERSE TRANSCRIPTASE ASSAY

The micro-reverse transcriptase (RT) assay was adapted from Goff et al. (Goff, S. et al., 1981, J. Virol. 38: 239–248) and Willey et al. (Willey, R. et al., 1988, J. Virol. 62: 139–147). Supernatants from virus/cell cultures were adjusted to 1% Triton-X100. 10 ul of each supernatant/Triton X-100 sample were added to 50 ul of RT cocktail (75 mM KC1, 2 mM Clevelands reagent, 5 mM MgCl$_2$, 5 $\mu$g/ml poly A, 0.25 units/ml oligo dT, 0.05% NP40, 50 mM Tris-HCl, pH 7.8, 0.5 $\mu$M non-radioactive dTTP, and 10 cci/ml $^{32}$P-dTTP) in a 96-well U-bottom microtitre plate and incubated at 37° C. for 90 min. After incubation, 40 $\mu$l of reaction mixture from each well was transferred to a Schleicher and Schuell (S+S) dot blot apparatus, under partial vacuum, containing a gridded 96-well filter-mat (Wallac catalog #1450-423) and filter backing saturated with 2× SSC buffer (0.3M NaCl and 0.003M sodium citrate). Each well was washed 4 times with at least 200 $\mu$l 2× SSC using full vacuum. Minifold was disassembled and gridded filter paper removed and washed 3 times with 2× SSC. Finally, the filter membrane was drained on absorbent paper, allowed to air dry, and sealed in heat sealable bags. Samples were placed in a phosphorscreen cassette and an erased (at least 8 min) phosphorscreen applied and closed. Exposure was for 16 hr. Pixel Index Values (PIV), generated in volume reporting format retrieved from phosphorimaging (Molecular Dynamics Phosphorimager) blots, were used to determine the affected or inhibited fraction (Fa) for all doses of inhibitor(s) when compared to untreated, infected controls (analyzed by ImageQuant volume report, corrected for background).

7.1.6. HUMAN PBMC INFECTIVITY/ NEUTRALIZATION

ASSAY

The prototypic assay used cell lines where the primary isolate assay utilizes PBMC, obtained through Interstate Blood Bank, activated for 2–3 days with a combination of OKT3 (0.5 $\mu$g/ml) and CD28 antibodies (0.1 $\mu$g/ml). The target cells were banded on lymphocyte separation medium (LSM), washed, and frozen. Cells were thawed as required and activated as indicated above a minimum of 2–3 days prior to assay. In this 96-well format assay, cells were at a concentration of 2×10$^6$/ml in 5% IL-2 medium and a final volume of 100 μl. Peptide stock solutions were made in DPBS (1 mg/ml). Peptide dilutions were performed in 20% FBS RPM1 1640/5% IL-2 complete medium.

7.1.7. IN VIVO HU-PBMC SCID MODEL OF HIV-1 INFECTION

Female SCID mice (5–7 weeks old) received $5-10 \times 10^7$ adult human PBMC injected intraperitoneally. Two weeks after reconstitution, mice were infected IP on day 0 with $10^3$ $TCID_{50}$ HIV-1 9320 (AZT-sensitive isolate A018). Treatment with peptides was IP, bid, beginning day -1 and continuing through day 6. The extent of infection in blood cells, splenocytes, lymph nodes, and peritoneal cells was assayed by quantitative co-culture with human PBMC blasts weekly for three consecutive weeks following animal exanguinations and tissue harvest (day 7, approximately 12–18 hours following the last drug treatment). Co-culture supernatants were evaluated for HIV-1 p24 antigen production as a measure of virus infection (Immunotek Coulter kits and protocol).

7.1.8. RAT PHARMACOKINETIC STUDIES

−300 g male CD rats, double jugular catheter, obtained from Charles River Laboratories were used. Peptides were injected in one jugular catheter in a volume of 200 μl of peptide solution (approximately 3.75 mg/ml), dosing solution concentration was determined using the Edelhoch method, (Edelhoch, 1967, Biochemistry 6:1948–1954) method and adjusted based on animal weight such that each animal received a dose of 2.5 mg/kg). Approximately 250–300 μl of blood was removed at predetermined time intervals (0, 15, 30 min and 1, 2, 4, 6, and 8 hours) and added to EDTA capiject tubes. Plasma was removed from pelleted cells upon centrifugation and either frozen or immediately processed for fluorescence HPLC analysis.

7.1.9. FLUORESCENCE HPLC ANALYSIS OF PLASMA SAMPLES

μl of sample plasma was added to 900 μl of precipitation buffer (acetonitrile, 0.1% TFA, detergent) resultingin precipitation of the majority of plasma proteins. Following centrifugation at 10,000 rpm for 10 min, 400 μl of the supernatant was removed and added to 600 μl of HPLC grade water. Serial dilutions were performed as dictated by concentration of peptide present in each sample in dilution buffer comprised of 40% precipitation buffer and 60% HPLC water. In addition to sample dilutions, serial dilutions of dosing solution were performed in buffer as well as in plasma and used to generate a standard curve relating peak area to known concentration of peptide. This curve was then used to calculate concentration of peptide in plasma taking into account all dilutions performed and quantity injected onto column.

7.1.10. XTT PROTOCOL

In order to measure cytotoxic/cytostatic effects of peptides, XTT assays (Weislow, O. S. et al., 1989, J. Natl. Cancer Inst. 81:577–586) were performed in the presence of varying concentrations of peptide in order to effectively establish a selective index (SI). A TC50 was determined in this assay by incubating cells in the presence and absence of serially diluted peptide followed by the addition of XTT. In surviving/metabolizing cells XTT is reduced to a soluble brown dye, XTT-formazan. Absorbance is read and comparisons made between readings in the presence and absence of peptide to determine a $TC_{50}$ utilizing the Karber method (see. e.g., Lennette, E. H. et al., eds., 1969, "Diagnostic Procedures for Viral and Rickettsial Infections," American Public Health Association, Inc., fourth ed., pp. 47–52). Molt 4, CEM (80,000 cells/well) and a combination of the two cell types (70,000 and 10,000 respectively) were plated and incubated with serially diluted peptide for 24 hours in a total volume of 100 μl. Following incubation, 25 μl of XTT working stock (1 mg/ml XTT, 250 μM PMS in complete medium containing 5% DMSO) was added to each well and the plates incubated at 37° C. Color development was read and results used to express values generated from peptide containing wells as a percentage of the untreated control wells.

7.2. RESULTS

7.2.1. ANTIVIRAL ACTIVITY—FUSION ASSAYS

T1249 was directly compared to T20 in virus mediated cell—cell fusion assays conducted using chronically infected CEM cells mixed with uninfected Molt-4 cells, as shown in Table 2, below. T1249 fusion inhibition against lab isolates such as IIIb, MN, and RF is comparable to T20, and displays an approximately 2.5–5-fold improvement over T20. T1249 was also mor e active (3–28 fold improvement) than T20 against several syncytia-inducing clinical isolates, including an AZT resistant isolate (G691-2), a pre-AZT treatment isolate (G762-3), and 9320 (isolate used in HuPBMC-SCID studies). Most notably, T1249 was over 800-fold more potent than T20 against HIV-2 NIHZ.

TABLE 2

| Virus Isolate | T20 (ng/ml) | n | T1249 (ng/ml) | n | Fold Difference |
|---|---|---|---|---|---|
| HIV-1 IIIb | 2.5 | 9 | 1.0 | 9 | 2.5 |
| HIV-1 G691-2 (AZT-R) | 406.0 | 1 | 16.0 | 1 | 25 |
| HIV-1 G762-3 (Pre-AZT) | 340.1 | 1 | 12.2 | 1 | 28 |
| HIV-1 MN | 20.0 | 7 | 3.1 | 7 | 6 |
| HIV-1 RF | 6.1 | 7 | 2.1 | 7 | 3 |
| HIV-1 9320 | 118.4 | 1 | 34.5 | 1 | 3 |
| HIV-2 NIHZ | 3610.0 | >10 | 4.3 | 2 | 840 |

7.2.2. ANTIVIRAL ACTIVITY - Magi-CCR-5 INFECTIVITY ASSAYS

Magi-CCR-5 infectivity assays allow direct comparisons to be made of syncytia and non-syncytia inducing virus isolates, as well as comparisons between laboratory and clinical isolates. The assay is also a direct measure of virus infection (TAT expression following infection, transactivating an LTR driven beta-galactosidase production), as opposed to commonly used indirect measures of infectivity such as p24 antigen or reverse transcriptase production. Magi-CCR-5 infectivity assays (see Table 3 below) reveal that T1249 is consistently more effective than T20 against all isolates tested, in terms of both EC5 and Vn/Vo =0.1 inhibition calculations. T1249 shows considerable improvement in potency against the clinical isolate HIV-1 301714 (>25-fold), which is one of the least sensitive isolates to T20. In addition, T1249 is at least 100-fold more potent than T20 against the SIV isolate B670. These data, along with fusion data suggest that T1249 is a potent peptide inhibitor of HIV-1, HIV-2, and SIV.

TABLE 3

| Virus Isolate | T20 EC-50 | T20 Vn/Vo = 0.1 | T1249 EC-50 | T1249 Vn/Vo = 0.1 | EC-50 Fold Difference | Vn/Vo = 0.1 Fold Difference |
|---|---|---|---|---|---|---|
| HIV-1 | | | | | | |
| IIIB | 42 | 80 | 8 | 10 | 5 | 8 |
| 9320 | 11 | 50 | 1 | 6 | 11 | 8 |
| 301714 (subtype B, NSI) | 1065 | 4000 | 43 | 105 | 25 | 38 |
| G691-2 (AZT-R) | 13 | 200 | 0.3 | 20 | 43 | 10 |
| pNL4-3 | 166 | 210 | 1 | 13 | 166 | 16 |
| SIV-B670 | 2313 | >10000 | 21 | 100 | 110 | >100 |

7.2.3. ANTIVIRAL ACTIVITY—HUPBMC INFECTIVITY ASSAYS

T1249 was directly compared to T20 in HUPBMC infectivity assays (Table 4, below), which represent a recognized surrogate in vitro system to predict plasma drug concentrations required for viral inhibition in vivo. These comparisons revealed that T1249 is more potent against all HIV-1 isolates tested to date, with all Vn/Vo=0.1 (dose required to reduce virus titer by one log) values being reduced to submicrogram concentrations. Many of the least sensitive clinical isolates to T20 exhibited 10-fold or greater sensitivity to T1249. It is noteworthy that HIV-1 9320, the isolate used in the HUPBMC SCID mouse model of infection, is 46-fold less sensitive to T20 than to T1249, indicating a very good correlation with the in vivo results.

TABLE 4

| Virus Isolate (HIV-1) | T20 Vn/Vo = 0.1 (ng/ml) | T1249 Vn/Vo = 0.1 (ng/ml) | Fold Difference |
|---|---|---|---|
| IIIB | 250 | 80 | 3 |
| 9320 | 6000 | 130 | 46 |
| 301714 (subtype B, NSI) | 8000 | 700 | 11 |
| 302056 (subtype B, NSI) | 800 | 90 | 9 |
| 301593 (subtype B, SI) | 3500 | 200 | 18 |
| 302077 (subtype A) | 3300 | 230 | 14 |
| 302143 (SI) | 1600 | 220 | 7 |
| G691-2 (AZT-R) | 1300 | 400 | 3 |

7.2.4. ANTIVIRAL ACTIVITY—T20 RESISTANT LAB ISOLATES

T1249 was directly compared to T20 in virus mediated cell—cell fusion assays conducted using chronically infected CEM cells mixed with uninfected Molt-4 cells (Table 5, below). T1249 was nearly 200-fold more potent than T20 against a T20-resistant isolate.

TABLE 5

| Virus Isolate | T20 (ng/ml) | n | T1249 (ng/ml) | n | Fold Difference |
|---|---|---|---|---|---|
| HIV-1 pNL4-3 SM (T20 Resistant) | 405.3 | 3 | 2.1 | 3 | 193 |

In Magi-CCR-5 assays (see Table 6, below), T1249 is as much as 50,000-fold more potent than T20 against T20-resistant isolates such as pNL4-3 SM and pNL4-3 STM (Rimskyl L. and Matthews, T., 1998, J. Virol. 72:986–993).

TABLE 6

| Virus Isolate | T20 EC-50 | T20 Vn/Vo = 0.1 | T1249 EC-50 | T1249 Vn/Vo = 0.1 | EC-50 Fold Difference | Vn/Vo = 0.1 Fold Difference |
|---|---|---|---|---|---|---|
| HIV-1 | | | | | | |
| pNL4-3 | 166 | 210 | 1 | 13 | 166 | 16 |
| pNL4-3 SM (T20-R) | 90 | 900 | 4 | 11 | 23 | 82 |
| pNL4-3 SM (T20-R) Duke | 410 | 2600 | 4 | 11 | 103 | 236 |

TABLE 6-continued

| | T20 | | T1249 | | EC-50 | Vn/Vo = 0.1 |
|---|---|---|---|---|---|---|
| Virus Isolate | EC-50 | Vn/Vo = 0.1 | EC-50 | Vn/Vo = 0.1 | Fold Difference | Fold Difference |
| pNL4-3 STM (T20/T649-R) Duke | >50000 | >50000 | 1 | 13 | >50000 | >3846 |

T1249 was directly compared to T20 in HuPBMC infectivity assays (see Table 7, below), evaluating differences in potency against a resistant isolate. T1249 is greater than 250-fold more potent than T20 against the resistant isolate pNL4-3 SM.

TABLE 7

| Virus Isolate (HIV-1) | T20 Vn/Vo = 0.1 (ng/ml) | T1249 Vn/Vo = 0.1 (ng/ml) | Fold Difference |
|---|---|---|---|
| HIV-1 pNL4-3 | 3500 | 30 | 117 |
| pNL4-3 SM (T20-R) | >10000 | 40 | >250 |

7.2.5. ANTIVIRAL ACTIVITY—IN VIVO SCID-HuPBMC MODEL

In vivo antiviral activity of T1249 was directly compared to T20 activity in the HuPBMC-SCID mouse model of HIV-1 9320 infection (FIG. 3). Two weeks after reconstitution with HuPBMCs, mice were infected IP on day 0 with $10^3$ TCID$_{50}$ HIV-19320 passed in PBMCs (AZT-sensitive isolate A018). Treatment with peptides was IP, bid, for total daily doses of 67 mg/kg (T20), 20 mg/kg (T1249), 6.7 mg/kg (T1249), 2.0 mg/kg (T1249), and 0.67 mg/kg (T1249), for 8 days beginning on day -1. The extent of infection in blood cells, splenocytes, lymph nodes, and peritoneal cells was assayed by quantitative co-culture with human PBMC blasts weekly for three consecutive weeks following animal exanguinations and tissue harvest (day 7, approx. 12 to 18 hours following last drug treatment). Co-culture supernatants were evaluated for HIV-1 p24 antigen production as a measure of virus infection. Infectious virus was not detectable in the blood or lymph tissues of the T20-treated animals, although, virus was detected in the peritoneal washes and spleen preparation. All compartments were negative for infectious virus at the 6.7 mg/kg dose of T1249, indicating at least a 10-fold improvement over T20 treatment. At the 2.0 mg/kg dose of T1249, both the lymph and the spleen were completely free of detectable infectious virus, with a 2 log$_{10}$ reduction in virus titer in the peritoneal wash and a 1 log$_{10}$ reduction in virus titer in the blood, compared to infected controls. At the lowest dose of T1249, 0.67 mg/kg, the peritoneal washes and blood were equivalent to infected control; however, at least a 1 log$_{10}$ drop in infectious virus titer was observed in both the lymph and the spleen tissues. Overall, the results indicate that T1249 is between 30 and 100-fold more potent against HIV-1 9320, in vivo, under these conditions.

7.2.6. PHARMACOKINETIC STUDIES—RAT

Figure 4A:
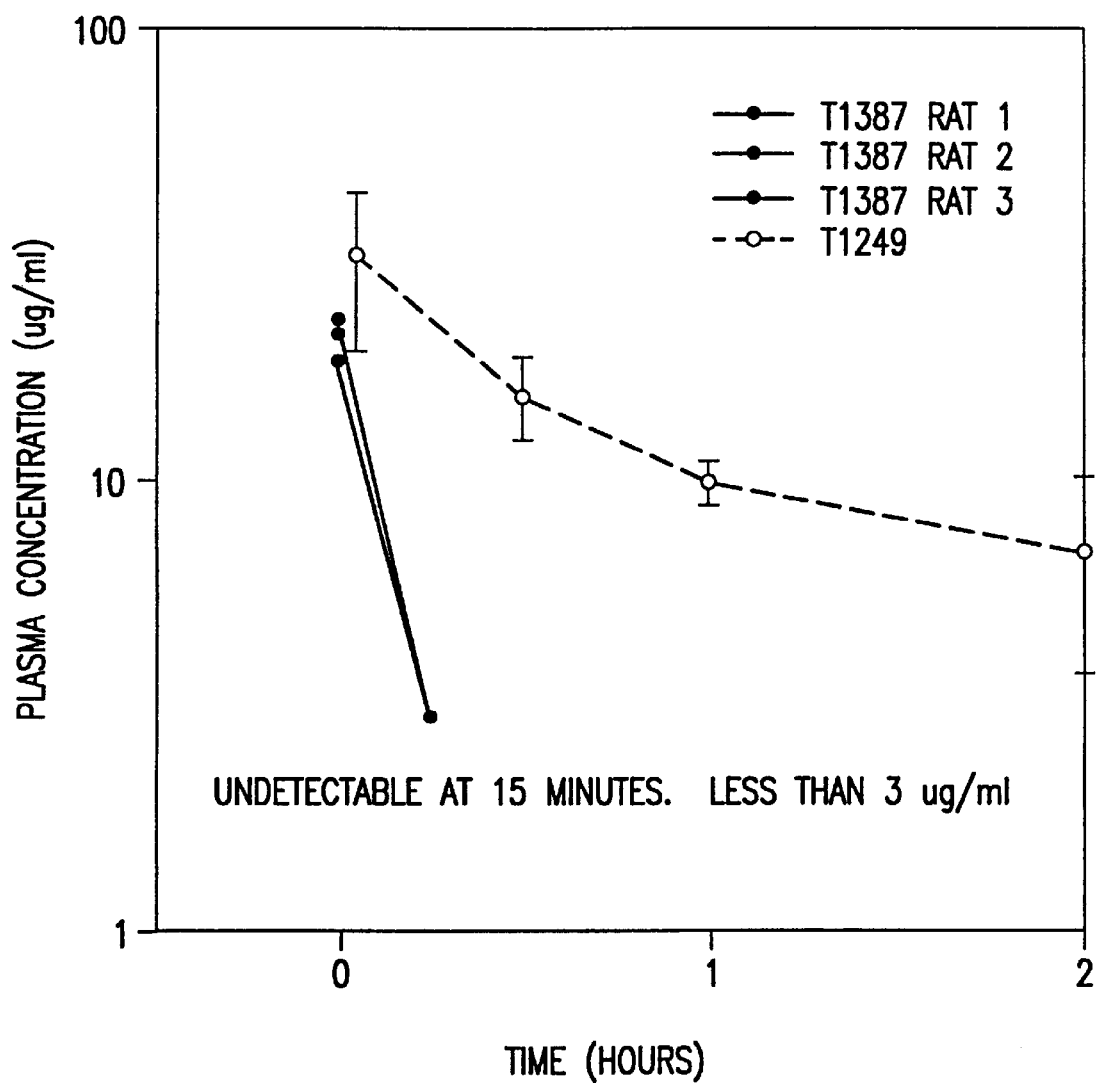
Figure 4B:
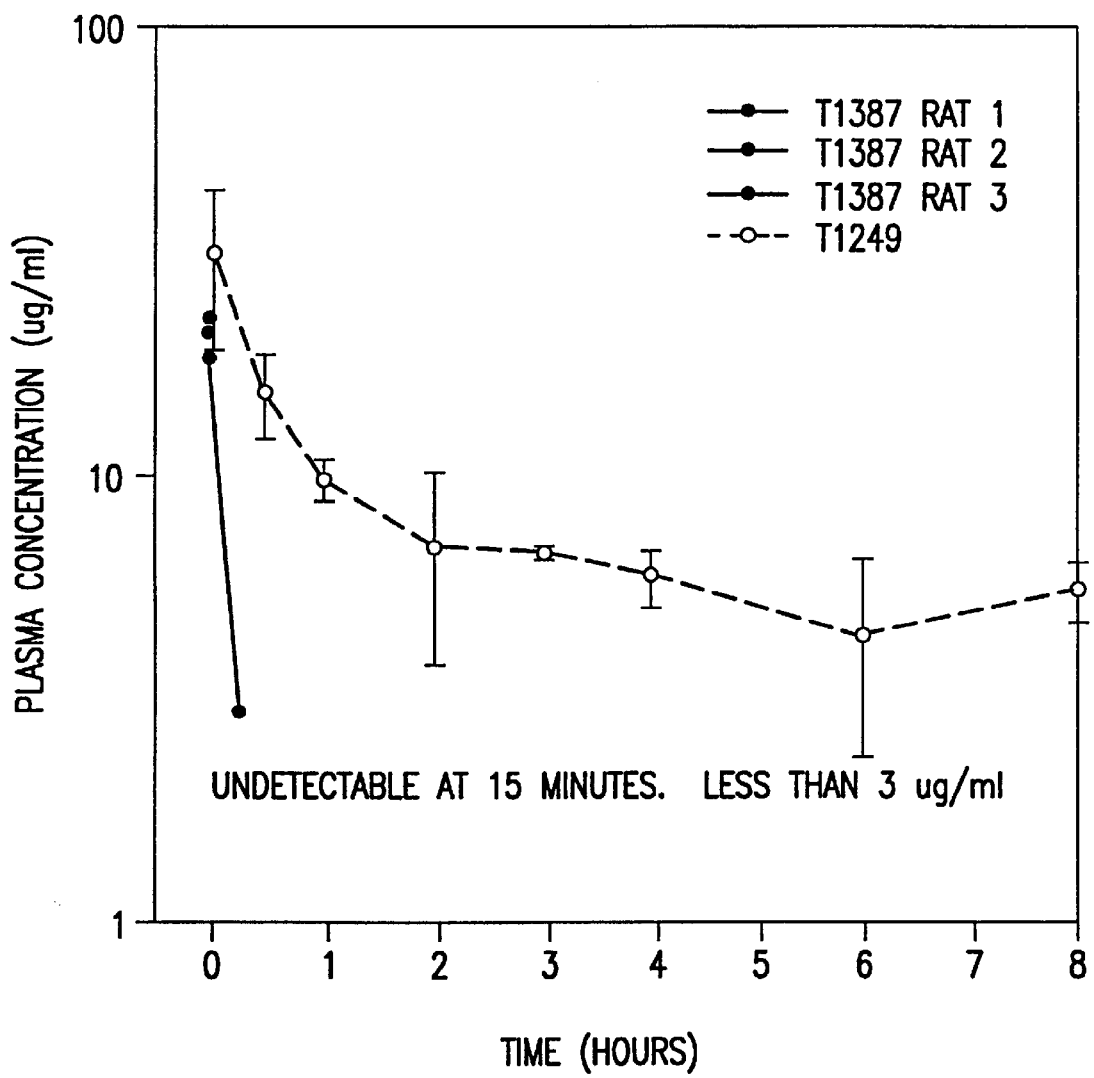
Figure 5:
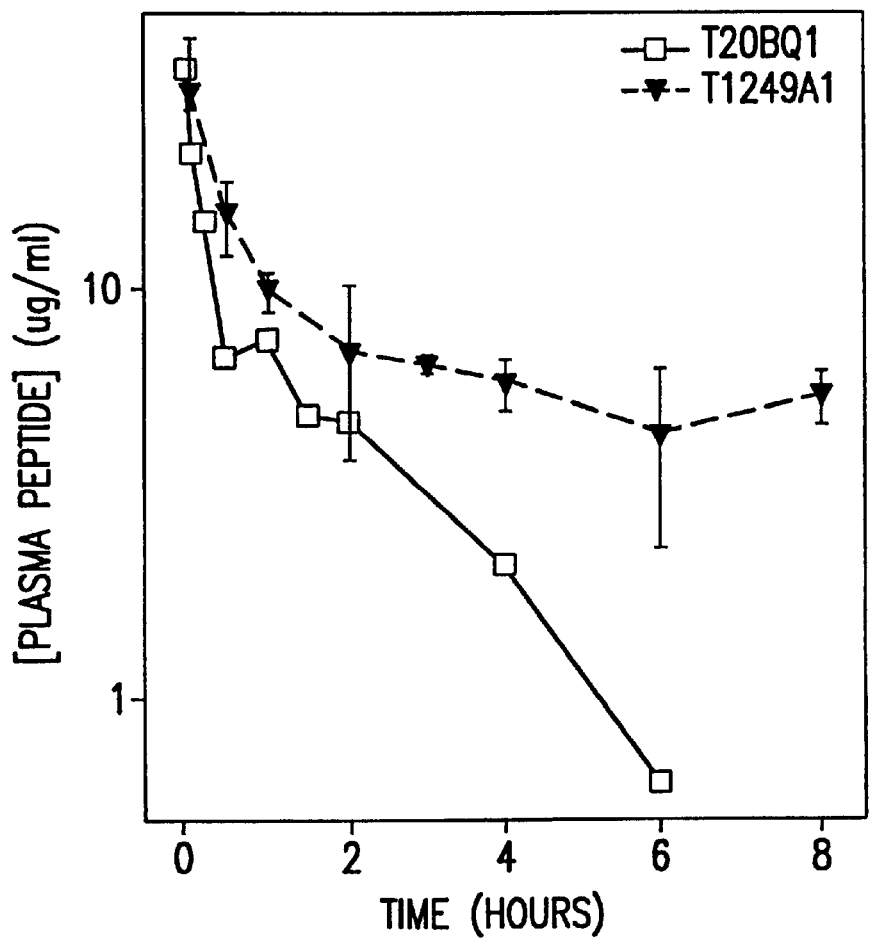

Cannulated rats were used to further define the pharmacokinetic profile of T1249. Male CD rats, 250–300 g, were dosed IV through a jugular catheter with T1249 and T20 (FIGS. 4A–5). The resulting plasma samples were evaluated using fluorescence HPLC to estimate peptide quantities in extracted plasma. The beta-phase half-life and total AUC of T1249 was nearly three times greater than T20 (FIG. 5).

7.2.7. CYTOTOXICITY

Figure 6:
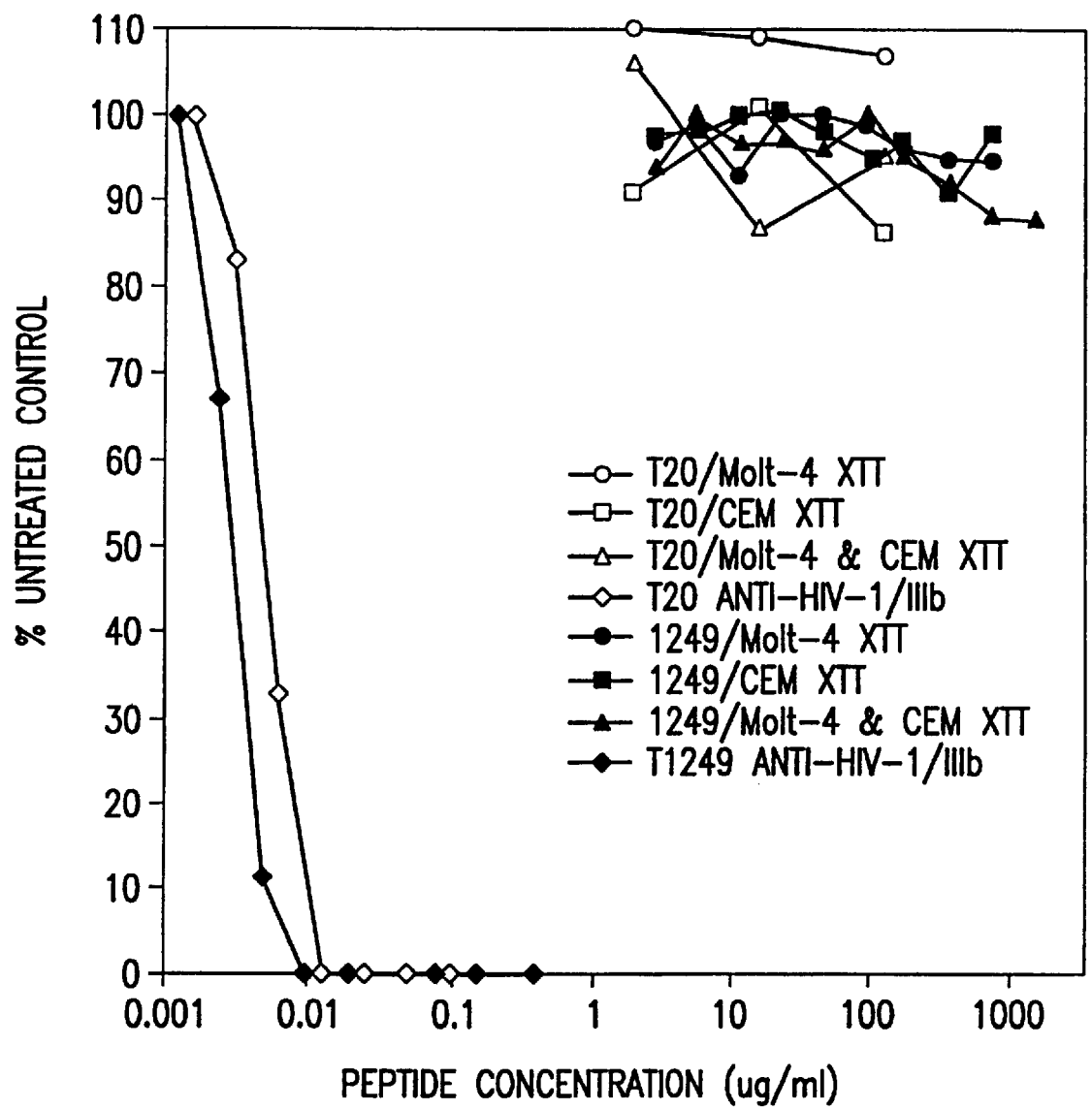

No overt evidence of T1249 cytotoxicity has been observed in vitro, as demonstrated in FIG. 6.

In addition, T1249 is not acutely toxic (death within 24 hours) at 167 mg/kg (highest dose tested) given IV through jugular cannula (0.3 ml over 2–3 min).

7.2.8. DIRECT BINDING TO gp41 CONSTRUCT M41Δ178

Figure 7A:
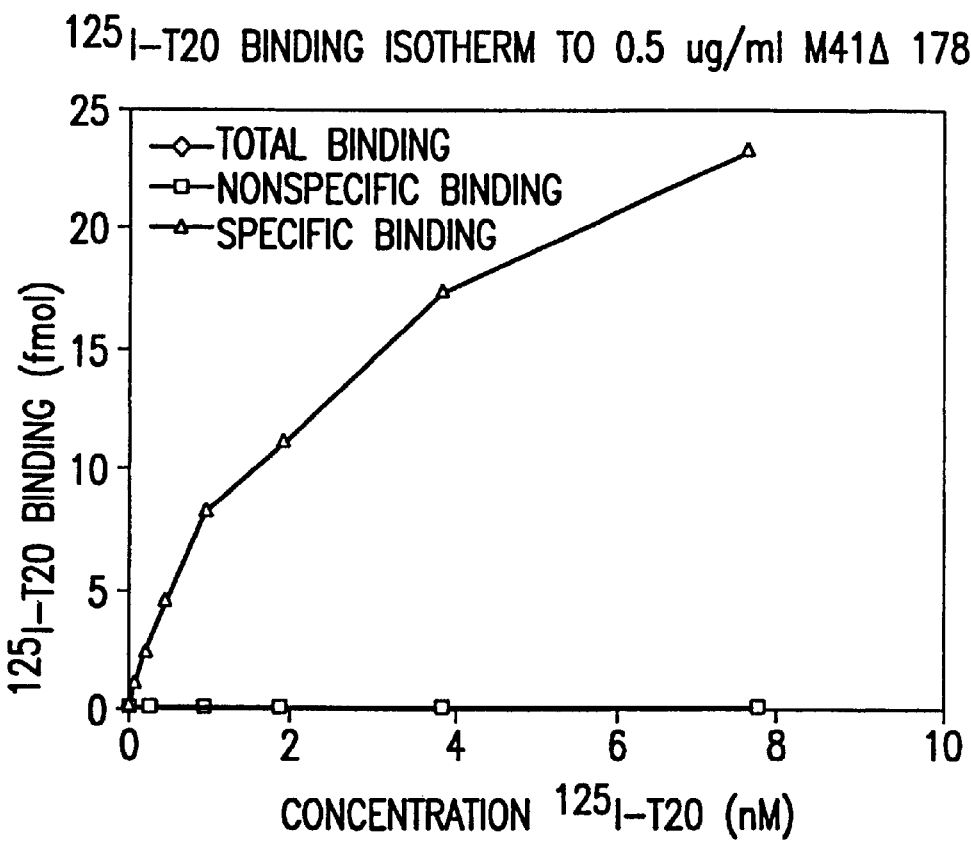
Figures 1, 7A:
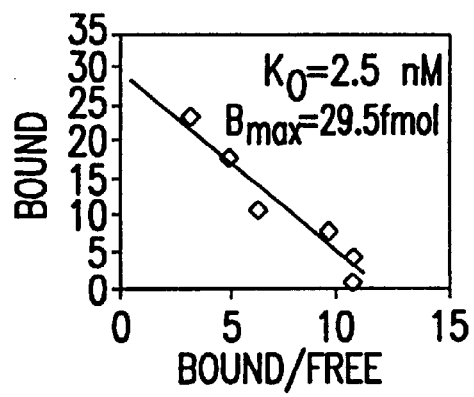
Figure 7B:
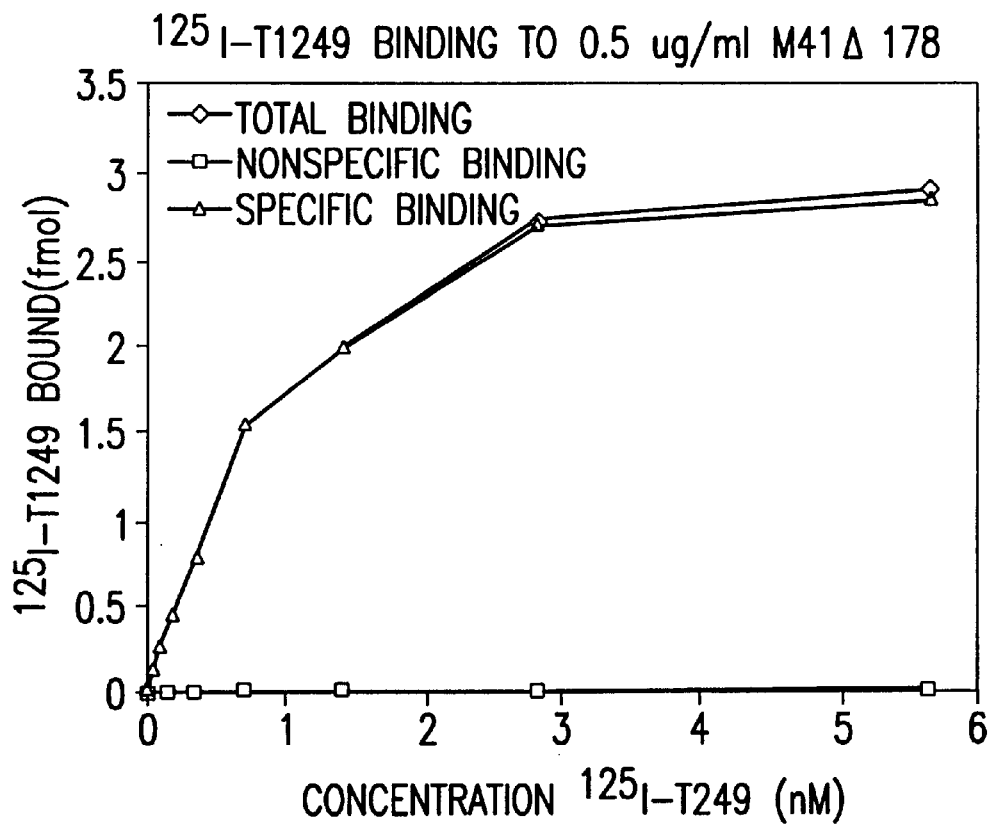
Figures 1, 7B:
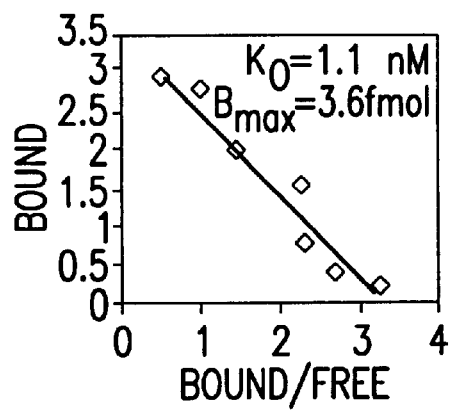

T1249 was radiolabeled with $^{125}$I and HPLC- purified to maximum specific activity. T20 was iodinated in the same manner. Saturation binding of to M41Δ178 (a truncated gp41 actodomain fusion protein lacking the T20 amino acid sequence) immobilized on microtitre plates at 0.5 mg/μl is shown in FIGS. 7A–B. Nonspecific binding was defined as binding of the radioligand in the presence of 1 μM unlabeled peptide. Specific binding was the difference between total and nonspecific binding. The results demonstrate that $^{125}$I-T1249 and $^{125}$I-T20 have similar binding affinities of 1–2 nM. Linear inverse Scatchard plots suggests that each ligand binds to a homogeneous class of sites.

Figure 8A:
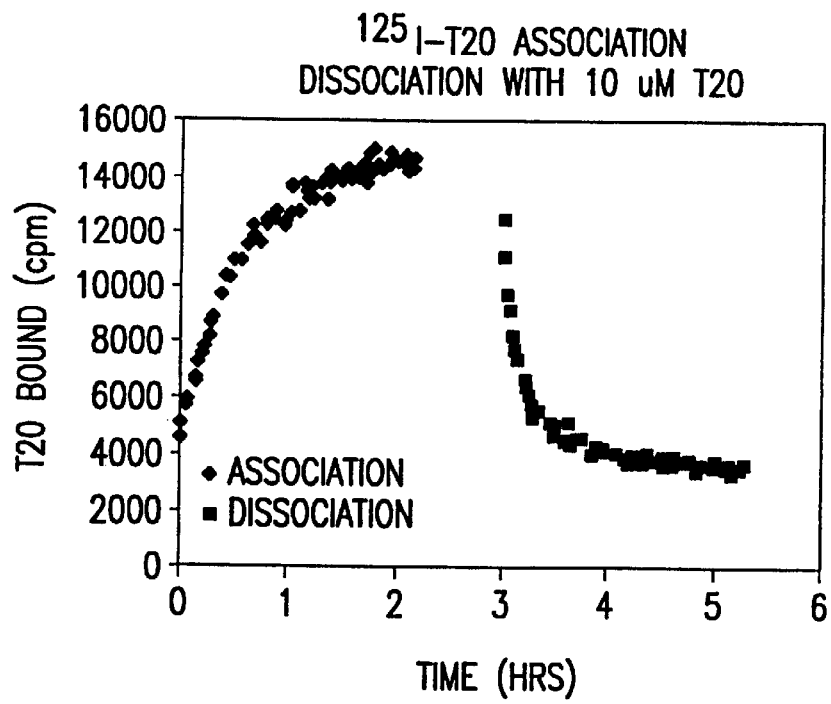
Figure 8B:
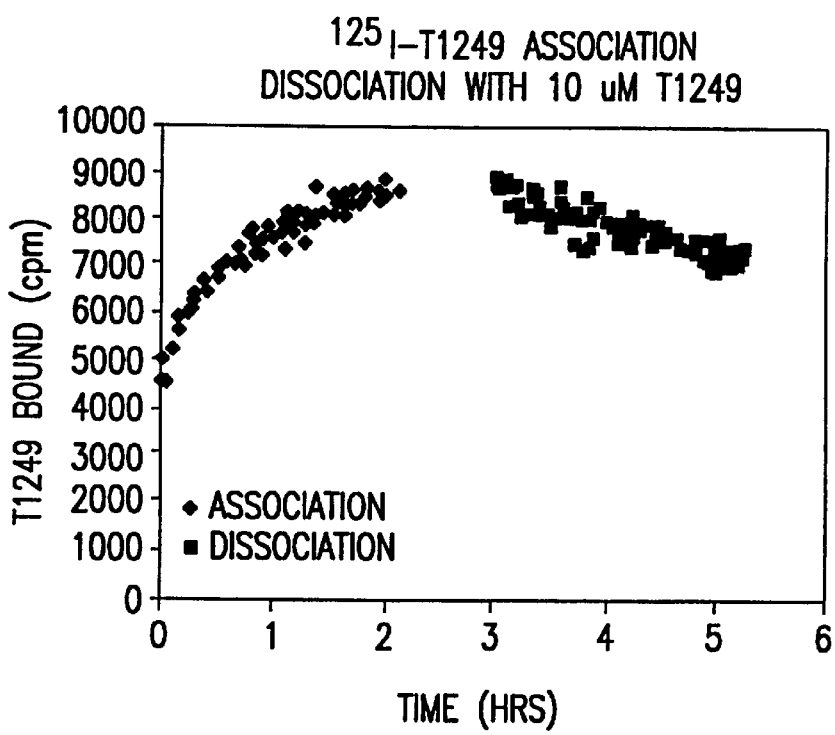

The kinetics of $^{125}$I-T1249 and $^{125}$I-T20 binding was determined on scintillating microtitre plates coated with 0.5 μg/ml M41Δ178. The time course for association and dissociation is shown in FIGS. 8A–B. Dissociation of bound radioligand was measured following the addition of unlabeled peptide to a final concentration of 10 μM in one-tenth of the total assay volume. Initial on- and off-rates for $^{125}$I-T1249 were significantly slower than those of $^{125}$I-T20. Dissociation patterns for both radioligands were unchanged when dissociation was initiated with the other unlabeled peptide (i.e., $^{125}$I-T1249 with T20).

Figure 9A:
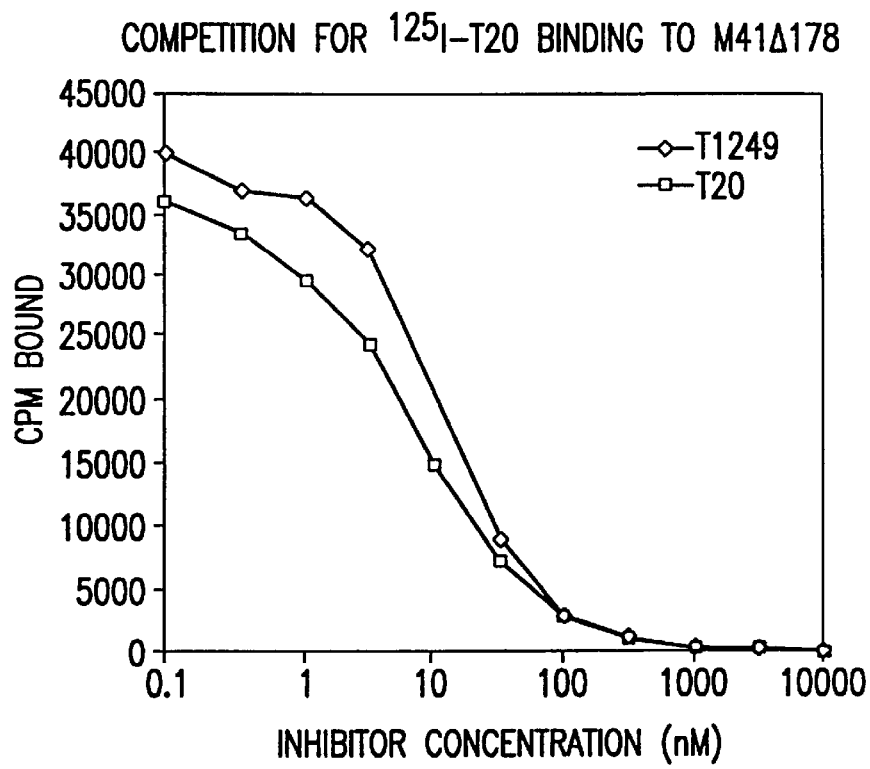
Figure 9B:
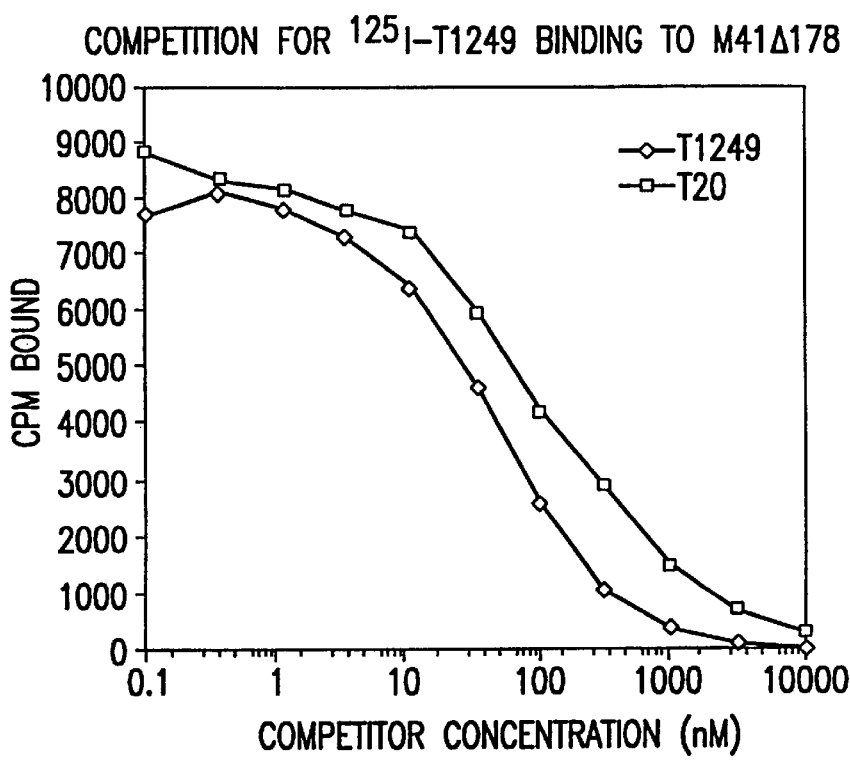

To further demonstrate that both ligands compete for the same target site, unlabeled T1249 and T20 were titrated in the presence of a single concentration of either $^{125}$I-T1249 or $^{125}$I-T20. Ligand was added just after the unlabeled peptide to start the incubation. The competition curves shown in FIGS. 9A–B suggest that although both ligands have similar affinities, a higher concentration of unlabeled peptide is required to fully compete for bound $^{125}$I-T 1249.

8. EXAMPLE: RESPIRATORY SYNCYTIAL VIRUS HYBRID POLYPEPTIDES

The following example describes respiratory syncytial virus (RSV) hybrid polypeptides with enhanced pharmacokinetic properties. In addition, results are presented, below, which demonstrate that the RSV hybrid polypeptides represent potent nhibitors of RSV infection.

8.1. MATERIALS AND METHODS

8.1.1. PEPTIDE-SYNTHESIS AND PURIFICATION

RSV polypeptides were synthesized using standard Fast Moc chemistry. Generally, unless otherwise noted, the peptides contained amidated carboxyl termini and acetylated amino termini. Purification was carried out by reverse phase HPLC.

8.1.2. RESPIRATORY SYNCYTIAL VIRUS PLAQUE REDUCTION ASSAY

All necessary dilutions of peptides were performed in clean, sterile 96-well TC plate. A total of eleven dilutions for each peptide and one control well containing no peptide were assembled. The final concentration range of peptide started at 50 µg/ml or 100 µg/ml, with a total of eleven two-fold dilutions. The RSV was prepared at a concentration of 100PFU/well in 100 µl 3%EMEM, as determined by a known titer of RSV. The virus is then added to all of the wells.

The media was removed from one sub-confluent 96-well plate of Hep2 cells. The material from the dilution plate was transferred onto the cell plates starting with row 1 and then transferring row 12, row 11, etc. until all rows were transferred. Plates were placed back into the incubator for 48 hours.

The cells were checked to ensure that syncytia were present in the control wells. Media was removed and approximately 50 µls of 0.25% Crystal Violet in methanol was added to each well. The wells were rinsed immediately in water to remove excess stain and allowed to dry. Using a dissecting microscope, the number of syncytia in each well was counted.

8.2. RESULTS

Figure 10A:
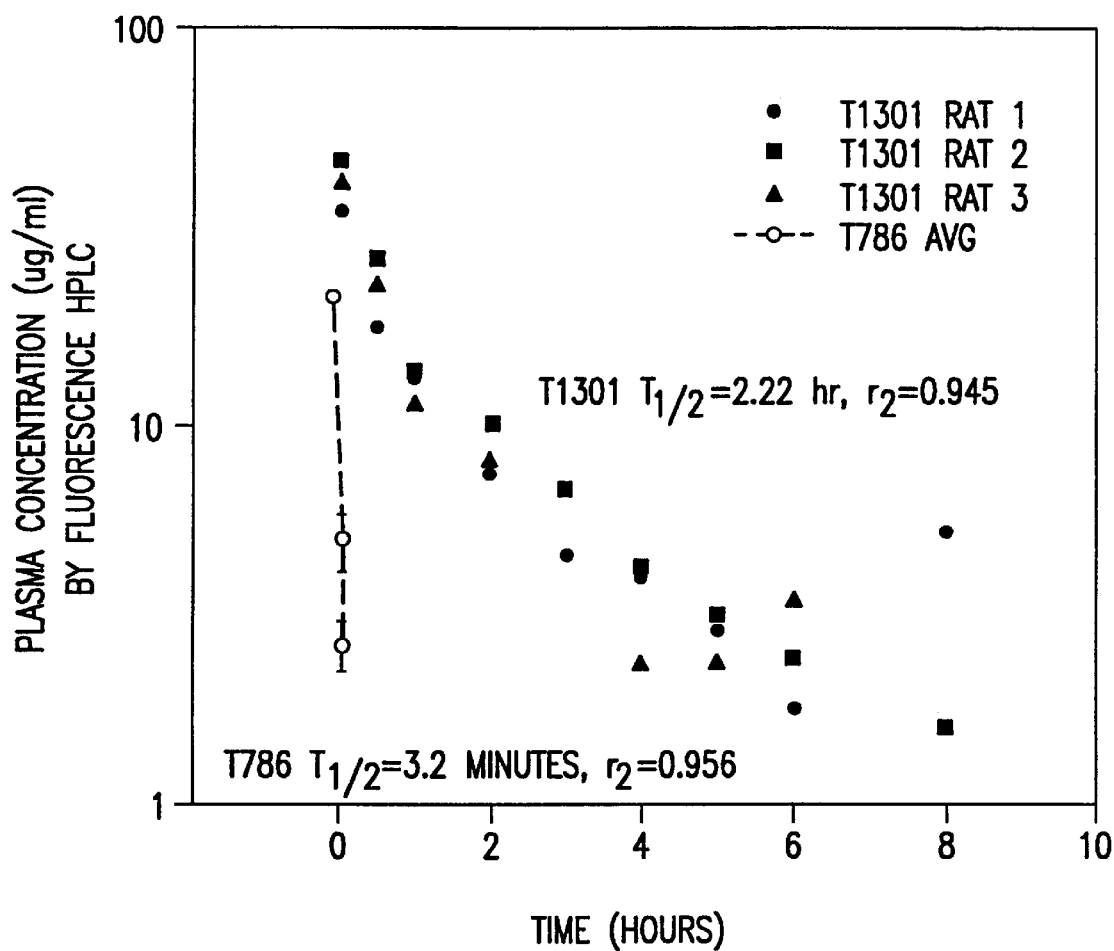
Figure 10B:
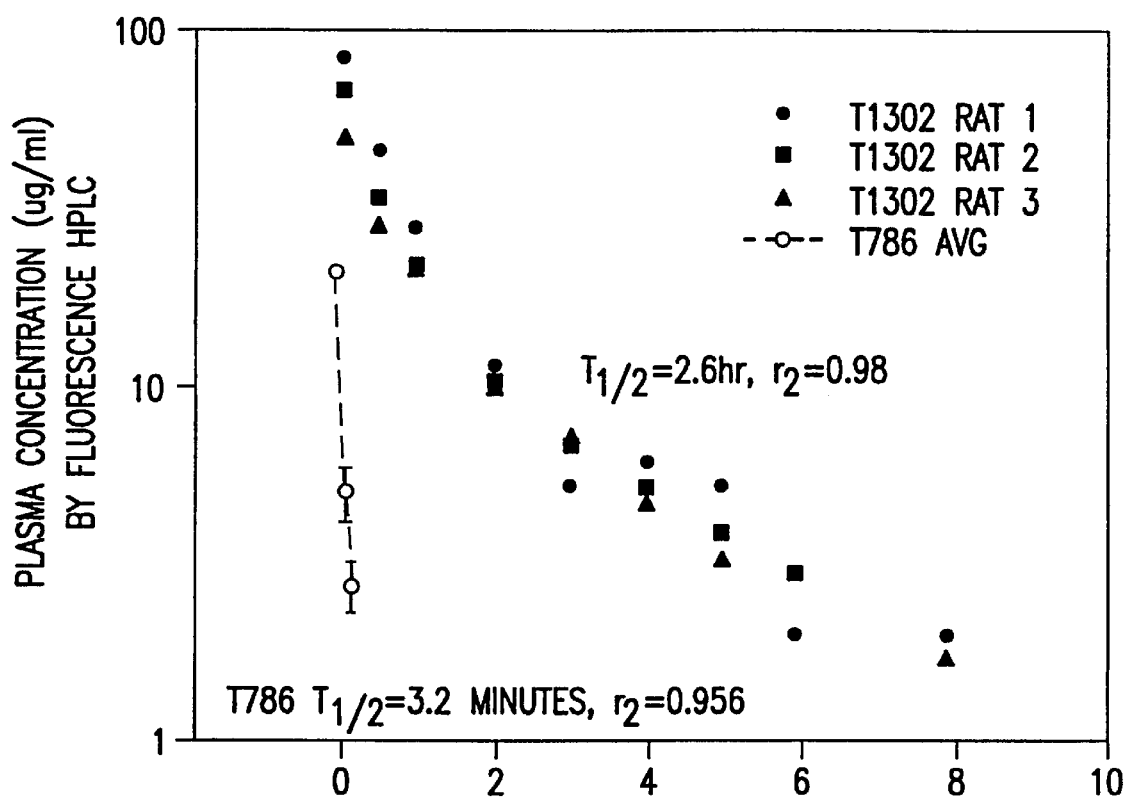

Pharmacokinetic studies with the RSV hybrid peptides T1301 (Ac-WQEWDEYDASISQVNEKINQALAYIREADELWAWF-NH2) (SEQ ID NO: 1122) and T1302 (Ac-WQAWDEYDASISQVNEKINQALAYIREADELWAWF-NH2) (SEQ ID NO: 1123) containing enhancer peptide sequences demonstrated a greatly enhanced half-life relative to core peptide T786 (Ac-VYPSDEYDASISQVNEEINQALAYIRKADELLENV-NH2) (SEQ ID NO:692), as demonstrated in FIGS. 10A–10B. Hybrid polypeptides T1301, T1302 and T1303 (Ac-WQAWDEYDASISDVNEKINQALAYIREADELWEWF-NH2) (SEQ ID NO:1124) also showed a greatly enhanced half-size relative to core peptide T1476 (Ac-DEYDASISQVNEKINQALAYIREADEL-NH2) (SEQ ID NO: 1416).

Figure 11A:
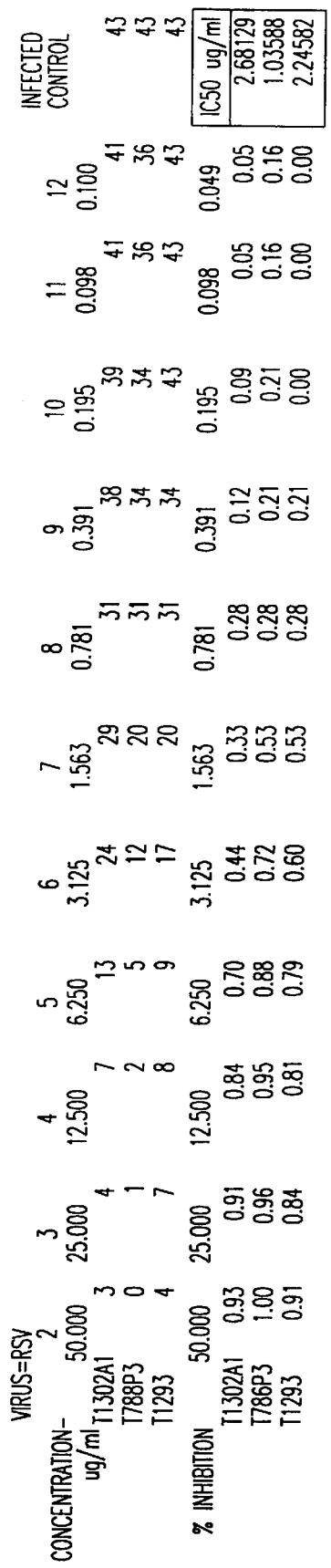
Figure 11A:
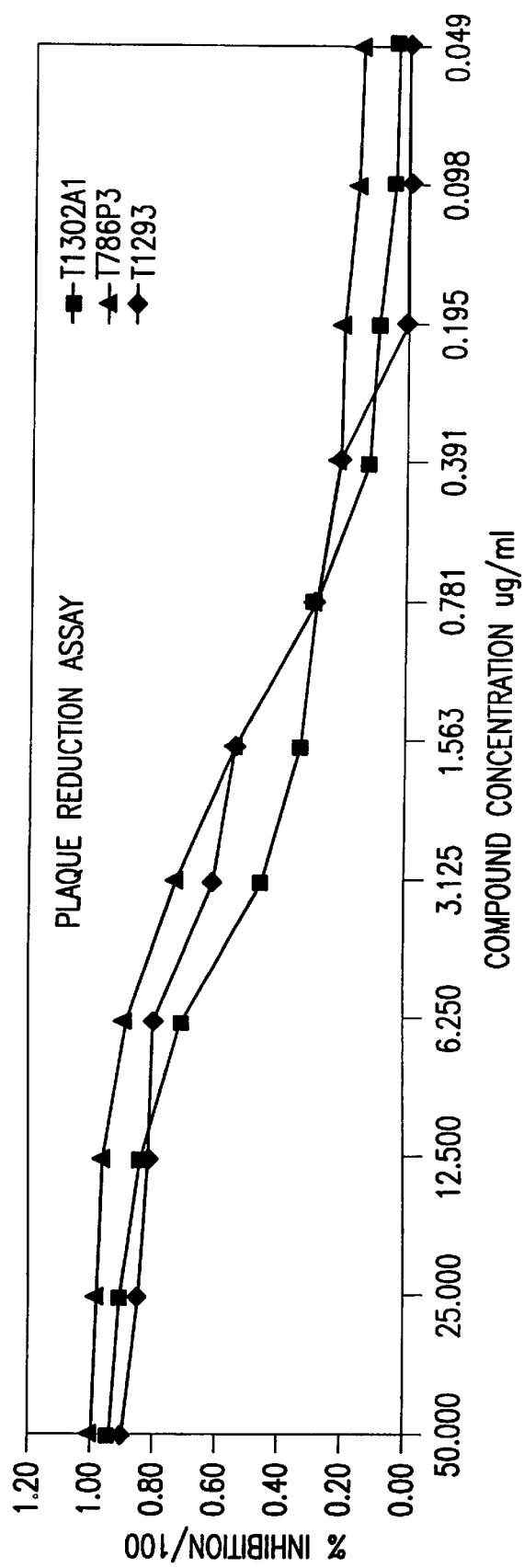
Figure 11B:
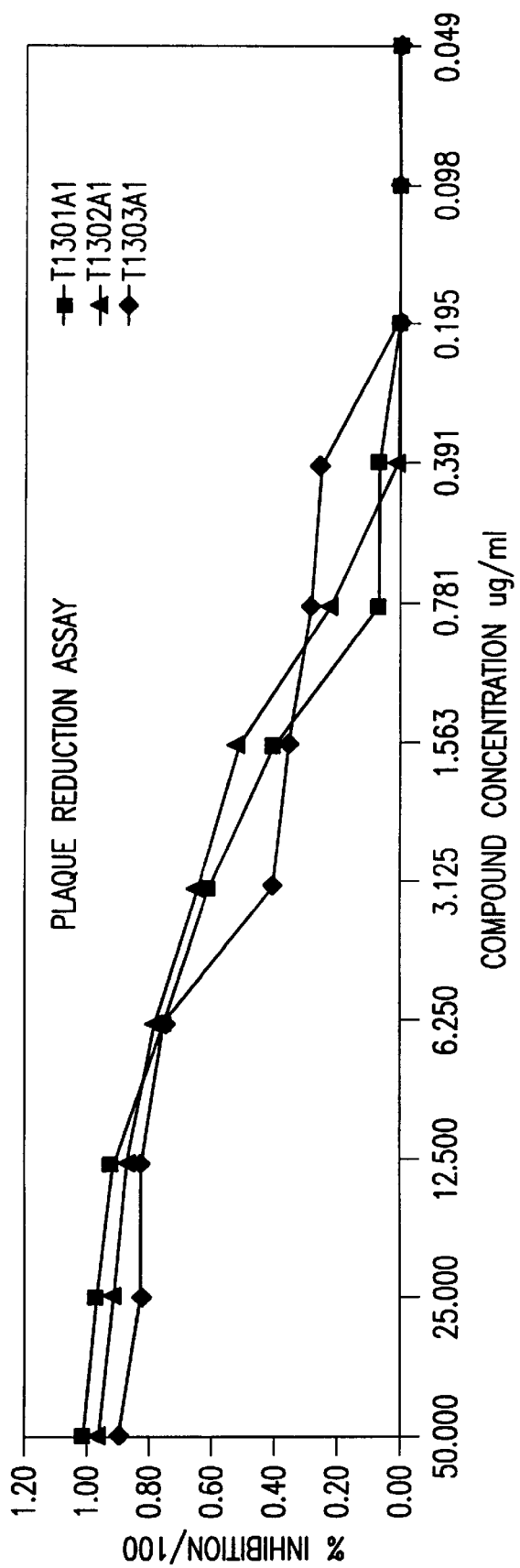

RSV hybrid polypeptides T1301, T1302 and T1303, as well as polypeptide T786 and T1293, were tested for their ability to inhibit RSV plaque formation of HEp2 cells. As indicated in FIGS. 11A and 11B, both the tested hybrid RSV polypeptides, as well as the T786 core polypeptide were able to inhibit RSV infection. Surprisingly, the T1293 hybrid polypeptide was also revealed to be a potent anti-RSV compound (FIGS. 13A–D).

9. EXAMPLE: LUTEINIZING HORMONE HYBRID POLYPEPTIDES

Figure 12A:
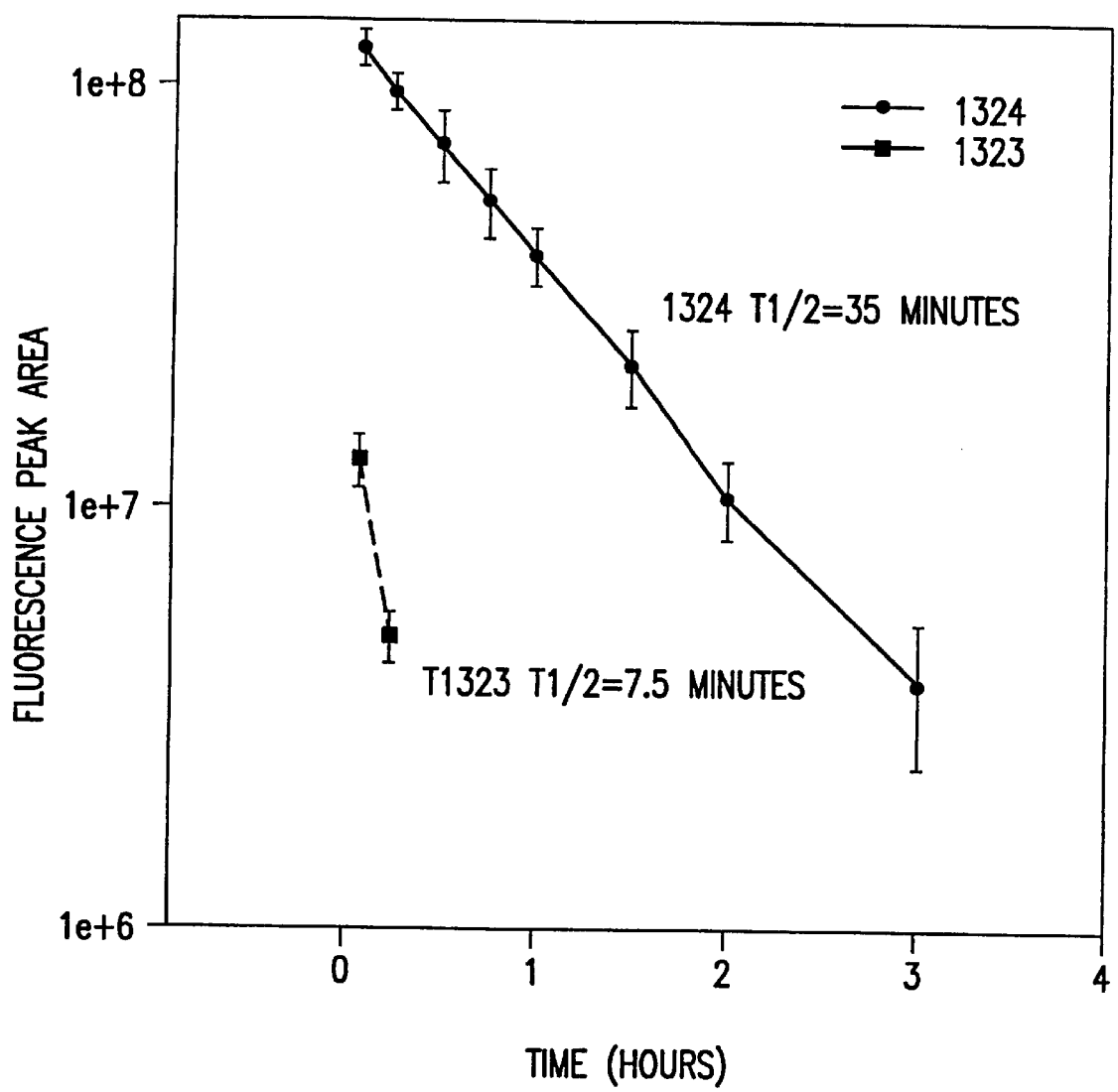
Figure 12B:
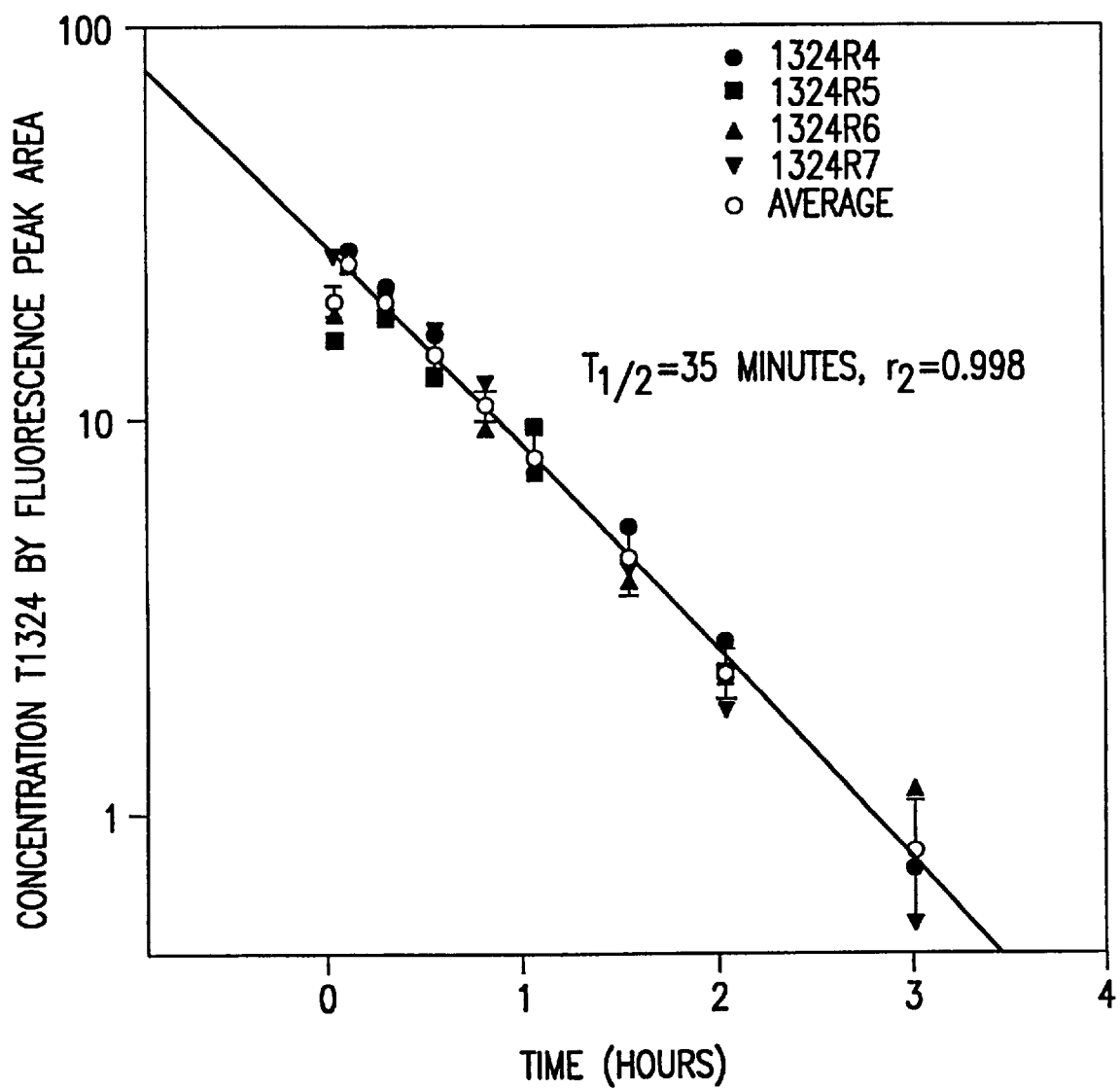

The example presented herein describes luteinizing hormone (LH) hybrid proteins with enhanced pharmacokinetic properties. The following LH hybrid peptides were synthesized and purified using the methods described above: core peptide T1323 (Ac-QHWSYGLRPG-NH2) (SEQ ID NO: 1143) and hybrid polypeptide T1324 (Ac-WQEWEQKIQHWSYGLRPGWASLWEWF-NH2) (SEQ ID NO: 1144) which comprises the core polypeptide T1323 amino acid sequence coupled with enhancer peptides at its amino- and carboxy-termini. As demonstrated in FIGS. 12A and 12B, the T1324 hybrid peptide exhibited a significantly increased half-life when compared to the T1323 core peptide which lacks the enhancer peptide sequences.

The present invention is not to be limited in scope by the specific embodiments described herein, which are intended as single illustrations of individual aspects of the invention, and functionally equivalent methods and components are within the scope of the invention. Indeed, various modifications of the invention, in addition to those shown and described herein will become apparent to those skilled in the art from the foregoing description and accompanying drawings. Such modifications are intended to fall within the scope of the appended claims.

SEQUENCE LISTING (1515 sequences)

SEQ ID NO: 1 - protein, 19 aa, Artificial Sequence
  Core polypeptide
GIKQLQARILAVERYLKDQ

SEQ ID NO: 2 - protein, 19 aa, Artificial Sequence
  Core polypeptide
NNLLRAIEAQQHLLQLTVW

SEQ ID NO: 3 - protein, 18 aa, Artificial Sequence
  Core polypeptide
NEQELLELDKWASLWNWF

SEQ ID NO: 4 - protein, 18 aa, Artificial Sequence
  Core polypeptide
YTSLIHSLIEESQNQQEK

SEQ ID NO: 5 - protein, 28 aa, Artificial Sequence
  Core polypeptide
VWGIKQLQARILAVERYLKDQQLLGIWG

SEQ ID NO: 6 - protein, 28 aa, Artificial Sequence
  Core polypeptide
QHLLQLTVWGIKQLQARILAVERYLKDQ

SEQ ID NO: 7 - protein, 28 aa, Artificial Sequence
  Core polypeptide
LRAIEAQQHLLQLTVWGIKQLQARILAV

SEQ ID NO: 8 - protein, 28 aa, Artificial Sequence
  Core polypeptide
VQQQNNLLARIEAQQHLLQLTVWGIKQL

SEQ ID NO: 9 - protein, 28 aa, Artificial Sequence
  Core polypeptide
RQLLSGIVQQQNNLLRAIEAQQHLLQLT

SEQ ID NO: 10 - protein, 28 aa, Artificial Sequence
  Core polypeptide
MTLTVQARQLLSGIVQQQNNLLRAIEAQ

SEQ ID NO: 11 - protein, 27 aa, Artificial Sequence
  Core polypeptide
VVSLSNGVSVLTSKVLDLKNYIDKQLL

SEQ ID NO: 12 - protein, 28 aa, Artificial Sequence
  Core polypeptide
LLSTNKAVVSLSNGVSVLTSKVLDLKNY

SEQ ID NO: 13 - protein, 28 aa, Artificial Sequence
  Core polypeptide
VLHLEGEVNKIKSALLSTNKAVVSLSNG

SEQ ID NO: 14 - protein, 28 aa, Artificial Sequence
  Core polypeptide
LLSTNKAVVSLSNGVSVLTSKVLDLKNY

SEQ ID NO: 15 - protein, 36 aa, Artificial Sequence
  Core polypeptide
YTSLIHSLIEESQNQQEKNEQELLELDKWASLWNWF

SEQ ID NO: 16 - protein, 38 aa, Artificial Sequence
  Core polypeptide
NNLLRAIEAQQHLLQLTVWGIKQLQARILAVERYLKDQ

SEQ ID NO: 17 - protein, 42 aa, Artificial Sequence
  Core polypeptide
IELSNIKENKCNGTDAKVKLIKQELDKYKNAVTELQLLMQST

SEQ ID NO: 18 - protein, 28 aa, Artificial Sequence
  Core polypeptide
IELSNIKENKCNGTDAKVKLIKQELDKY

SEQ ID NO: 19 - protein, 28 aa, Artificial Sequence
  Core polypeptide
ENKCNGTDAKVKLIKQELDKYKNAVTEL

SEQ ID NO: 20 - protein, 28 aa, Artificial Sequence
  Core polypeptide
DAKVKLIKQELDKYKNAVTELQLLMQST

SEQ ID NO: 21 - protein, 28 aa, Artificial Sequence
  Core polypeptide
CNGTDAKVKLIKQELDKYKNAVTELQLL

SEQ ID NO: 22 - protein, 35 aa, Artificial Sequence
  Core polypeptide
SNIKENKCNGTDAKVKLIKQELDKYKNAVTELQLL

SEQ ID NO: 23 - protein, 37 aa, Artificial Sequence
  Core polypeptide
ASGVAVSKVLHLEGEVNKIKSALLSTNKAVVSLSNGV

SEQ ID NO: 24 - protein, 35 aa, Artificial Sequence
  Core polypeptide
SGVAVSKVLHLEGEVNKIKSALLSTNKAVVSLSNG

SEQ ID NO: 25 - protein, 35 aa, Artificial Sequence
  Core polypeptide
VLHLEGEVNKIKSALLSTHKAVVSLSNGVSVLTSK

SEQ ID NO: 26 - protein, 36 aa, Artificial Sequence
  Core polypeptide
ARKLQRMKQLEDKVEELLSKNYHYLENEVARLKKLV

SEQ ID NO: 27 - protein, 34 aa, Artificial Sequence
  Core polypeptide
RMKQLEDKVEELLSKNYHYLENEVARLKKLVGER

SEQ ID NO: 28 - protein, 28 aa, Artificial Sequence
  Core polypeptide
VQQQNNLLRAIEAQQHLLQLTVWGIKQL

SEQ ID NO: 29 - protein, 28 aa, Artificial Sequence
  Core polypeptide
LRAIEAQQHLLQLTVWGIKQLQARILAV

SEQ ID NO: 30 - protein, 28 aa, Artificial Sequence
  Core polypeptide
QHLLQLTVWGIKQLQARILAVERYLKDQ

SEQ ID NO: 31 - protein, 28 aa, Artificial Sequence
  Core polypeptide
RQLLSGIVQQQNNLLRAIEAQQHLLQLT

SEQ ID NO: 32 - protein, 28 aa, Artificial Sequence
  Core polypeptide
MTLTVQARQLLSGIVQQQNNLLRAIEAQ

SEQ ID NO: 33 - protein, 28 aa, Artificial Sequence
  Core polypeptide
AKQARSDIEKLKEAIRDTNKAVQSVQSS

SEQ ID NO: 34 - protein, 35 aa, Artificial Sequence
  Core polypeptide
AAVALVEAKQARSDIEKLKEAIRDTNKAVQSVQSS

SEQ ID NO: 35 - protein, 35 aa, Artificial Sequence
  Core polypeptide
AKQARSDIEKLKEAIRDTNKAVQSVQSSIGNLIVA

SEQ ID NO: 36 - protein, 28 aa, Artificial Sequence
  Core polypeptide
GTIALGVATSAQITAAVALVEAKQARSD

SEQ ID NO: 37 - protein, 28 aa, Artificial Sequence
  Core polypeptide
ATSAQITAAVALVEAKQARSDIEKLKEA

SEQ ID NO: 38 - protein, 28 aa, Artificial Sequence
  Core polypeptide
AAVALVEAKQARSDIEKLKEAIRDTNKA

SEQ ID NO: 39 - protein, 35 aa, Artificial Sequence
  Core polypeptide
IDISIELNKAKSDLEESKEWIEKSNQELDSIGNWE

SEQ ID NO: 40 - protein, 28 aa, Artificial Sequence
  Core polypeptide
IEKLKEAIRDTNKAVQSVQSSIGNLIVA

SEQ ID NO: 41 - protein, 28 aa, Artificial Sequence
  Core polypeptide
IRDTNKAVQSVQSSIGNLIVAIKSVQDY

SEQ ID NO: 42 - protein, 28 aa, Artificial Sequence
  Core polypeptide
AVQSVQSSIGNLIVAIKSVQDYVNKEIV

SEQ ID NO: 43 - protein, 50 aa, Artificial Sequence
  Core polypeptide
QARQLLSGIVQQQNNLLRAIEAQQHLLQLTVWGIKQLARILAVERYLKDQ

SEQ ID NO: 44 - protein, 28 aa, Artificial Sequence
  Core polypeptide
QARQLLSGIVQQQNNLLRAIEAQQHLLQ

SEQ ID NO: 45 - protein, 48 aa, Artificial Sequence
  Core polypeptide
MTWMEMDREINNYTSLIGSLIEESQNQQEKNEQELLELDKWASLWNWF

SEQ ID NO: 46 - protein, 35 aa, Artificial Sequence
  Core polypeptide
WMEWDREINNYTSLIGSLIEESQNQQEKNEQELLE

SEQ ID NO: 47 - protein, 28 aa, Artificial Sequence
  Core polypeptide
INNYTSLIGSLIEESQNQQEKNEQELLE

SEQ ID NO: 48 - protein, 35 aa, Artificial Sequence
  Core polypeptide
INNYTSLIGSLIEESQNQQEKNEQELLELDKWASL

SEQ ID NO: 49 - protein, 33 aa, Artificial Sequence
  Core polypeptide
EWDREINNYTSLIGSLIEESQNQQEKNEQEGGC

SEQ ID NO: 50 - protein, 28 aa, Artificial Sequence
  Core polypeptide
QSRTLLAGIVQQQQQLLDVVKRQQELLR

SEQ ID NO: 51 - protein, 44 aa, Artificial Sequence
  Core polypeptide
NNDTWQEWERKVDFLEENITALLEEAQIQQEKNMYELQKLNSWD

SEQ ID NO: 52 - protein, 28 aa, Artificial Sequence
  Core polypeptide
WQEWERKVDFLEENITALLEEAQIQQEK

SEQ ID NO: 53 - protein, 28 aa, Artificial Sequence
  Core polypeptide
VDFLEENITALLEEAQIQQEKNMYELQK

SEQ ID NO: 54 - protein, 28 aa, Artificial Sequence
  Core polypeptide
ITALLEEAQIQQEKNMYELQKLNSWDVF

SEQ ID NO: 55 - protein, 36 aa, Artificial Sequence
  Core polypeptide
SSESFTLLEQWNNWKLQLAEQWLEQINEKHYLEDIS

SEQ ID NO: 56 - protein, 10 aa, Artificial Sequence
  Core polypeptide
DKWASLWNWF

SEQ ID NO: 57 - protein, 18 aa, Artificial Sequence
  Core polypeptide
NEQELLELDKWASLWNWF

SEQ ID NO: 58 - protein, 20 aa, Artificial Sequence
  Core polypeptide
EKNEQELLELDKWASLWNWF

SEQ ID NO: 59 - protein, 23 aa, Artificial Sequence
  Core polypeptide
NQQEKNEQELLELDKWASLWNWF

SEQ ID NO: 60 - protein, 26 aa, Artificial Sequence
  Core polypeptide
ESQNQQEKNEQELLELDKWASLWNWF

SEQ ID NO: 61 - protein, 33 aa, Artificial Sequence
  Core polypeptide
LIHSLIEESQNQQEKNEQELLELDKWASLWNWF

SEQ ID NO: 62 - protein, 28 aa, Artificial Sequence
  Core polypeptide
NDQKKLMSNNVQIVRQQSYSIMSIIKEE

SEQ ID NO: 63 - protein, 28 aa, Artificial Sequence
  Core polypeptide
DEFDASISQVNEKINQSLAFIRKSDELL

SEQ ID NO: 64 - protein, 27 aa, Artificial Sequence
  Core polypeptide
VSKGYSALRTGWYTSVITIELSNIKEN

SEQ ID NO: 65 - protein, 27 aa, Artificial Sequence
  Core polypeptide
VVSLSNGVSVLTSKVLDLKNYIDKQLL

SEQ ID NO: 66 - protein, 28 aa, Artificial Sequence
  Core polypeptide
VNKIKSALLSTNKAVVSLSNGVSVLTSK

SEQ ID NO: 67 - protein, 35 aa, Artificial Sequence
  Core polypeptide
PIINFYDPLVFPSDEFDASISQVNEKINQSLAFIR

SEQ ID NO: 68 - protein, 28 aa, Artificial Sequence
  Core polypeptide
NLVYAQLQFTYDTLRGYINRALAQIAEA

SEQ ID NO: 69 - protein, 31 aa, Artificial Sequence
  Core polypeptide
LNQVDLTETLERYQQRLNTYALVSKDASYRS

SEQ ID NO: 70 - protein, 27 aa, Artificial Sequence
  Core polypeptide
ELLVLKKAQLNRHSYLKDSDFLDAALD

SEQ ID NO: 71 - protein, 27 aa, Artificial Sequence
  Core polypeptide
LAEAGEESVTEDTEREDTEEEREDEEE

SEQ ID NO: 72 - protein, 35 aa, Artificial Sequence
  Core polypeptide
ALLAEAGEESVTEDTEREDTEEEREDEEEENEART

SEQ ID NO: 73 - protein, 35 aa, Artificial Sequence
  Core polypeptide
ETERSVDLVAALLAEAGEESVTEDTEREDTEEERE

SEQ ID NO: 74 - protein, 28 aa, Artificial Sequence
  Core polypeptide
EESVTEDTEREDTEEEREDEEEENEART

SEQ ID NO: 75 - protein, 28 aa, Artificial Sequence
  Core polypeptide
VDLVAALLAEAGEESVTEDTEREDTEEE

SEQ ID NO: 76 - protein, 25 aa, Artificial Sequence
  Core polypeptide
NSETERSVDLVAALLAEAGEESVTE

SEQ ID NO: 77 - protein, 28 aa, Artificial Sequence
  Core polypeptide
DISYAQLQFTYDVLKDYINDALRNIMDA

SEQ ID NO: 78 - protein, 30 aa, Artificial Sequence
  Core polypeptide
SNVFSKDEIMREYNSQKQHIRTLSAKVNDN

SEQ ID NO: 79 - protein, 35 aa, Artificial Sequence
  Core polypeptide
IDISIELNKAKSDLEEAKEWIKKANQKLDSIGNWH

SEQ ID NO: 80 - protein, 35 aa, Artificial Sequence
  Core polypeptide
IDISIELNKAKSDLEESKEWIKKANQKLDSIGNWH

SEQ ID NO: 81 - protein, 39 aa, Artificial Sequence
  Core polypeptide
YESTQKAFDGITNKVNSVIEKTNTQFEAVGKEFGNLEKR

SEQ ID NO: 82 - protein, 28 aa, Artificial Sequence
  Core polypeptide
DEYDASISQVNEKINQSLAFIRKSDELL

SEQ ID NO: 83 - protein, 38 aa, Artificial Sequence
  Core polypeptide
VLHQLNIQLKQYLETQERLLAGNRIAARQLLQIWKDVA

SEQ ID NO: 84 - protein, 38 aa, Artificial Sequence
  Core polypeptide
LWHEQLLNTAQRAGLQLQLINQALAVREKVLIRYDIQK

SEQ ID NO: 85 - protein, 35 aa, Artificial Sequence
  Core polypeptide
LLDNFESTWEQSKELWEQQEISIQNLHKSALQEYW

SEQ ID NO: 86 - protein, 36 aa, Artificial Sequence
  Core polypeptide
LSNLLQISNNSDEWLEALEIEHEKWKLTQWQSYEQF

SEQ ID NO: 87 - protein, 36 aa, Artificial Sequence
  Core polypeptide
KLEALEGKLEALEGKLEALEGKLEALEGKLEALEGK

SEQ ID NO: 88 - protein, 29 aa, Artificial Sequence
  Core polypeptide
ELRALRGELRALRGELRALRGELRALRGK

SEQ ID NO: 89 - protein, 36 aa, Artificial Sequence
  Core polypeptide
ELKAKELEGEGLAEGEEALKGLLEKAAKLEGLELLK

SEQ ID NO: 90 - protein, 33 aa, Artificial Sequence
  Core polypeptide
MEWDREINNYTSLIHSLIEESQNQQEKNEQELL

SEQ ID NO: 91 - protein, 36 aa, Artificial Sequence
  Core polypeptide
YTSLIHSLIEESQNQQEKNEQELLELDKWASLWNAF

SEQ ID NO: 92 - protein, 36 aa, Artificial Sequence
  Core polypeptide
YTSLIHSLIEESQNQQEKNEQELLELDKWASLANWF

SEQ ID NO: 93 - protein, 36 aa, Artificial Sequence
  Core polypeptide
YTSLIHSLIEESQNQQEKNQQELLELDKWASLWNWF

SEQ ID NO: 94 - protein, 36 aa, Artificial Sequence
  Core polypeptide
YTSLIHSLIEESQNQQEKNEQELLQLDKWASLWNWF

SEQ ID NO: 95 - protein, 36 aa, Artificial Sequence
  Core polypeptide
YTSLIHSLIEESQNQQEKNQQELLQLDKWASLWNWF

SEQ ID NO: 96 - protein, 33 aa, Artificial Sequence
  Core polypeptide
RMKQLEDKVEELLSKNYHLENEVARLKKLVGER

SEQ ID NO: 97 - protein, 28 aa, Artificial Sequence
  Core polypeptide
QQLLQLTVWGIKQLQARILAVERYLKNQ

SEQ ID NO: 98 - protein, 18 aa, Artificial Sequence
  Core polypeptide
NEQELLELDKWASLWNWF

SEQ ID NO: 99 - protein, 36 aa, Artificial Sequence
  Core polypeptide
YTSLIQSLIEESQNQQEKNEQELLELDKWASLWNWF

SEQ ID NO: 100 - protein, 35 aa, Artificial Sequence
  Core polypeptide
IINFYDPLVFPSDEFDASISQVNEKINQSLAFIRK

SEQ ID NO: 101 - protein, 35 aa, Artificial Sequence
  Core polypeptide
INFYDPLVFPSDEFDASISQVNEKINQSLAFIRKS

SEQ ID NO: 102 - protein, 35 aa, Artificial Sequence
  Core polypeptide
NFYDPLVFPSDEFDASISQVNEKINQSLAFIRKSD

SEQ ID NO: 103 - protein, 35 aa, Artificial Sequence
  Core polypeptide
FYDPLVFPSDEFDASISQVNEKINQSLAFIRKSDE

SEQ ID NO: 104 - protein, 35 aa, Artificial Sequence
  Core polypeptide
YDPLVFPSDEFDASISQVNEKINQSLAFIRKSDEL

SEQ ID NO: 105 - protein, 35 aa, Artificial Sequence
  Core polypeptide
DPLVFPSDEFDASISQVNEKINQSLAFIRKSDELL

SEQ ID NO: 106 - protein, 35 aa, Artificial Sequence
  Core polypeptide
PLVFPSDEFDASISQVNEKINQSLAFIRKSDELLH

SEQ ID NO: 107 - protein, 35 aa, Artificial Sequence
  Core polypeptide
LVFPSDEFDASISQVNEKINQSLAFIRKSDELLHN

SEQ ID NO: 108 - protein, 35 aa, Artificial Sequence
  Core polypeptide
VFPSDEFDASISQVNEKINQSLAFIRKSDELLHNV

SEQ ID NO: 109 - protein, 35 aa, Artificial Sequence
  Core polypeptide
FPSDEFDASISQVNEKINQSLAFIRKSDELLHNVN

SEQ ID NO: 110 - protein, 35 aa, Artificial Sequence
  Core polypeptide
PSDEFDASISQVNEKINQSLAFIRKSDELLHNVNA

SEQ ID NO: 111 - protein, 35 aa, Artificial Sequence
  Core polypeptide
SDEFDASISQVNEKINQSLAFIRKSDELLHNVNAG

SEQ ID NO: 112 - protein, 35 aa, Artificial Sequence
  Core polypeptide
DEFDASISQVNEKINQSLAFIRKSDELLHNVNAGK

SEQ ID NO: 113 - protein, 35 aa, Artificial Sequence
  Core polypeptide
EFDASISQVNEKINQSLAFIRKSDELLHNVNAGKS

SEQ ID NO: 114 - protein, 35 aa, Artificial Sequence
  Core polypeptide
FDASISQVNEKINQSLAFIRKSDELLHNVNAGKST

SEQ ID NO: 115 - protein, 35 aa, Artificial Sequence
  Core polypeptide
DASISQVNEKINQSLAFIRKSDELLHNVNAGKSTT

SEQ ID NO: 116 - protein, 35 aa, Artificial Sequence
  Core polypeptide
ASGVAVSKVLHLEGEVNKIKSALLSTNKAVVSLSN

SEQ ID NO: 117 - protein, 35 aa, Artificial Sequence; identical to SEQ ID NO: 24
  Core polypeptide

SEQ ID NO: 118 - protein, 35 aa, Artificial Sequence
  Core polypeptide
GVAVSKVLHLEGEVNKIKSALLSTNKAVVSLSNGV

SEQ ID NO: 119 - protein, 35 aa, Artificial Sequence
  Core polypeptide
VAVSKVLHLEGEVNKIKSALLSTNKAVVSLSNGVS

SEQ ID NO: 120 - protein, 35 aa, Artificial Sequence
  Core polypeptide
AVSKVLHLEGEVNKIKSALLSTNKAVVSLSNGVSV

SEQ ID NO: 121 - protein, 35 aa, Artificial Sequence
  Core polypeptide
VSKVLHLEGEVNKIKSALLSTNKAVVSLSNGVSVL

SEQ ID NO: 122 - protein, 35 aa, Artificial Sequence
  Core polypeptide
SKVLHLEGEVNKIKSALLSTNKAVVSLSNGVSVLT

SEQ ID NO: 123 - protein, 35 aa, Artificial Sequence
  Core polypeptide
KVLHLEGEVNKIKSALLSTNKAVVSLSNGVSVLTS

SEQ ID NO: 124 - protein, 35 aa, Artificial Sequence
  Core polypeptide
VLHLEGEVNKIKSALLSTNKAVVSLSNGVSVLTSK

SEQ ID NO: 125 - protein, 35 aa, Artificial Sequence
  Core polypeptide
LHLEGEVNKIKSALLSTNKAVVSLSNGVSVLTSKV

SEQ ID NO: 126 - protein, 35 aa, Artificial Sequence
  Core polypeptide
HLEGEVNKIKSALLSTNKAVVSLSNGVSVLTSKVL

SEQ ID NO: 127 - protein, 35 aa, Artificial Sequence
  Core polypeptide
LEGEVNKIKSALLSTNKAVVSLSNGVSVLTSKVLD

SEQ ID NO: 128 - protein, 35 aa, Artificial Sequence
  Core polypeptide
EGEVNKIKSALLSTNKAVVSLSNGVSVLTSKVLDL

SEQ ID NO: 129 - protein, 35 aa, Artificial Sequence
  Core polypeptide
GEVNKIKSALLSTNKAVVSLSNGVSVLTSKVLDLK

SEQ ID NO: 130 - protein, 35 aa, Artificial Sequence
  Core polypeptide
EVNKIKSALLSTNKAVVSLSNGVSVLTSKVLDLKN

SEQ ID NO: 131 - protein, 35 aa, Artificial Sequence
  Core polypeptide
VNKIKSALLSTNKAVVSLSNGVSVLTSKVLDLKNY

SEQ ID NO: 132 - protein, 35 aa, Artificial Sequence
  Core polypeptide
NKIKSALLSTNKAVVSLSNGVSVLTSKVLDLKNYI

SEQ ID NO: 133 - protein, 35 aa, Artificial Sequence
  Core polypeptide
KIKSALLSTNKAVVSLSNGVSVLTSKVLDLKNYID

SEQ ID NO: 134 - protein, 35 aa, Artificial Sequence
  Core polypeptide
IKSALLSTNKAVVSLSNGVSVLTSKVLDLKNYIDK

SEQ ID NO: 135 - protein, 35 aa, Artificial Sequence
  Core polypeptide
KSALLSTNKAVVSLSNGVSVLTSKVLDLKNYIDKQ

SEQ ID NO: 136 - protein, 35 aa, Artificial Sequence
  Core polypeptide
SALLSTNKAVVSLSNGVSVLTSKVLDLKNYIDKQL

SEQ ID NO: 137 - protein, 35 aa, Artificial Sequence
  Core polypeptide
ALLSTNKAVVSLSNGVSVLTSKVLDLKNYIDKQLL

SEQ ID NO: 138 - protein, 35 aa, Artificial Sequence
  Core polypeptide
YTSVITIELSNIKENKCNGTDAKVKLIKQELDKYK

SEQ ID NO: 139 - protein, 35 aa, Artificial Sequence
  Core polypeptide
TSVITIELSNIKENKCNGTDAKVKLIKQELDKYKN

SEQ ID NO: 140 - protein, 35 aa, Artificial Sequence
  Core polypeptide
SVITIELSNIKENKCNGTDAKVKLIKQELDKYKNA

SEQ ID NO: 141 - protein, 35 aa, Artificial Sequence
  Core polypeptide
VITIELSNIKENKCNGTDAKVKLIKQELDKYKNAV

SEQ ID NO: 142 - protein, 35 aa, Artificial Sequence
  Core polypeptide
ITIELSNIKENKCNGTDAKVKLIKQELDKYKNAVT

SEQ ID NO: 143 - protein, 35 aa, Artificial Sequence
  Core polypeptide
TIELSNIKENKCNGTDAKVKLIKQELDKYKNAVTE

SEQ ID NO: 144 - protein, 35 aa, Artificial Sequence
  Core polypeptide
IELSNIKENKCNGTDAKVKLIKQELDKYKNAVTEL

SEQ ID NO: 145 - protein, 35 aa, Artificial Sequence
  Core polypeptide
ELSNIKENKCNGTDAKVKLIKQELDKYKNAVTELQ

SEQ ID NO: 146 - protein, 35 aa, Artificial Sequence
  Core polypeptide
LSNIKENKCNGTDAKVKLIKQELDKYKNAVTELQL

SEQ ID NO: 147 - protein, 35 aa, Artificial Sequence; identical to SEQ ID NO: 22
  Core polypeptide

SEQ ID NO: 148 - protein, 35 aa, Artificial Sequence
  Core polypeptide
NIKENKCNGTDAKVKLIKQELDKYKNAVTELQLLM

SEQ ID NO: 149 - protein, 35 aa, Artificial Sequence
  Core polypeptide
IKENKCNGTDAKVKLIKQELDKYKNAVTELQLLMQ

SEQ ID NO: 150 - protein, 35 aa, Artificial Sequence
  Core polypeptide
KENKCNGTDAKVKLIKQELDKYKNAVTELQLLMQS

SEQ ID NO: 151 - protein, 35 aa, Artificial Sequence
  Core polypeptide
ENKCNGTDAKVKLIKQELDKYKNAVTELQLLMQST

SEQ ID NO: 152 - protein, 36 aa, Artificial Sequence
  Core polypeptide
LLDNFESTWEQSKELWELQEISIQNLHKSALQEYWN

SEQ ID NO: 153 - protein, 35 aa, Artificial Sequence
  Core polypeptide
ALGVATSAQITAAVALVEAKQARSDIEKLKEAIRD

SEQ ID NO: 154 - protein, 35 aa, Artificial Sequence
  Core polypeptide
LGVATSAQITAAVALVEAKQARSDIEKLKEAIRDT

SEQ ID NO: 155 - protein, 35 aa, Artificial Sequence
  Core polypeptide
GVATSAQITAAVALVEAKQARSDIEKLKEAIRDTN

SEQ ID NO: 156 - protein, 35 aa, Artificial Sequence
  Core polypeptide
VATSAQITAAVALVEAKQARSDIEKLKEAIRDTNK

SEQ ID NO: 157 - protein, 35 aa, Artificial Sequence
  Core polypeptide
ATSAQITAAVALVEAKQARSDIEKLKEAIRDTNKA

SEQ ID NO: 158 - protein, 35 aa, Artificial Sequence
  Core polypeptide
TSAQITAAVALVEAKQARSDIEKLKEAIRDTNKAV

SEQ ID NO: 159 - protein, 35 aa, Artificial Sequence
  Core polypeptide
SAQITAAVALVEAKQARSDIEKLKEAIRDTNKAVQ

SEQ ID NO: 160 - protein, 35 aa, Artificial Sequence
  Core polypeptide
AQITAAVALVEAKQARSDIEKLKEAIRDTNKAVQS

SEQ ID NO: 161 - protein, 35 aa, Artificial Sequence
  Core polypeptide
QITAAVALVEAKQARSDIEKLKEAIRDTNKAVQSV

SEQ ID NO: 162 - protein, 35 aa, Artificial Sequence
  Core polypeptide
ITAAVALVEAKQARSDIEKLKEAIRDTNKAVQSVQ

SEQ ID NO: 163 - protein, 35 aa, Artificial Sequence
  Core polypeptide
TAAVALVEAKQARSDIEKLKEAIRDTNKAVQSVQS

SEQ ID NO: 164 - protein, 35 aa, Artificial Sequence; identical to SEQ ID NO: 34
  Core polypeptide

SEQ ID NO: 165 - protein, 35 aa, Artificial Sequence
  Core polypeptide
AVALVEAKQARSDIEKLKEAIRDTNKAVQSVQSSI

SEQ ID NO: 166 - protein, 35 aa, Artificial Sequence
  Core polypeptide
VALVEAKQARSDIEKLKEAIRDTNKAVQSVQSSIG

SEQ ID NO: 167 - protein, 35 aa, Artificial Sequence
  Core polypeptide
ALVEAKQARSDIEKLKEAIRDTNKAVQSVQSSIGN

SEQ ID NO: 168 - protein, 35 aa, Artificial Sequence
  Core polypeptide
LVEAKQARSDIEKLKEAIRDTNKAVQSVQSSIGNL

SEQ ID NO: 169 - protein, 35 aa, Artificial Sequence
  Core polypeptide
VEAKQARSDIEKLKEAIRDTNKAVQSVQSSIGNLI

SEQ ID NO: 170 - protein, 35 aa, Artificial Sequence
  Core polypeptide
EAKQARSDIEKLKEAIRDTNKAVQSVQSSIGNLIV

SEQ ID NO: 171 - protein, 35 aa, Artificial Sequence
  Core polypeptide
KQARSDIEKLKEAIRDTNKAVQSVQSSIGNLIVAI

SEQ ID NO: 172 - protein, 34 aa, Artificial Sequence
  Core polypeptide
QARSDEKLKEAIRDTNKAVQSVQSSIGNLIVAIK

SEQ ID NO: 173 - protein, 35 aa, Artificial Sequence
  Core polypeptide
QARSDIEKLKEAIRDTNKAVQSVQSSIGNLIVAIK

SEQ ID NO: 174 - protein, 35 aa, Artificial Sequence
  Core polypeptide
ARSDIEKLKEAIRDTNKAVQSVQSSIGNLIVAIKS

SEQ ID NO: 175 - protein, 35 aa, Artificial Sequence
  Core polypeptide
RSDIEKLKEAIRDTNKAVQSVQSSIGNLIVAIKSV

SEQ ID NO: 176 - protein, 35 aa, Artificial Sequence
  Core polypeptide
SDIEKLKEAIRDTNKAVQSVQSSIGNLIVAIKSVQ

SEQ ID NO: 177 - protein, 35 aa, Artificial Sequence
  Core polypeptide
DIEKLKEAIRDTNKAVQSVQSSIGNLIVAIKSVQD

SEQ ID NO: 178 - protein, 35 aa, Artificial Sequence
  Core polypeptide
IEKLKEAIRDTNKAVQSVQSSIGNLIVAIKSVQDY

SEQ ID NO: 179 - protein, 35 aa, Artificial Sequence
  Core polypeptide
EKLKEAIRDTNKAVQSVQSSIGNLIVAIKSVQDYV

SEQ ID NO: 180 - protein, 35 aa, Artificial Sequence
  Core polypeptide
KLKEAIRDTNKAVQSVQSSIGNLIVAIKSVQDYVN

SEQ ID NO: 181 - protein, 35 aa, Artificial Sequence
  Core polypeptide
LKEAIRDTNKAVQSVQSSIGNLIVAIKSVQDYVNK

SEQ ID NO: 182 - protein, 35 aa, Artificial Sequence
  Core polypeptide
KEAIRDTNKAVQSVQSSIGNLIVAIKSVQDYVNKE

SEQ ID NO: 183 - protein, 35 aa, Artificial Sequence
  Core polypeptide
EAIRDTNKAVQSVQSSIGNLIVAIKSVQDYVNKEI

SEQ ID NO: 184 - protein, 35 aa, Artificial Sequence
  Core polypeptide
AIRDTNKAVQSVQSSIGNLIVAIKSVQDYVNKEIV

SEQ ID NO: 185 - protein, 34 aa, Artificial Sequence
  Core polypeptide
IRDTNKAVQSVQSSIGNLIVAIKSVQDYVNKEIV

SEQ ID NO: 186 - protein, 35 aa, Artificial Sequence
  Core polypeptide
YTPNDITLNNSVALDPIDISIELNKAKSDLEESKE

SEQ ID NO: 187 - protein, 35 aa, Artificial Sequence
  Core polypeptide
TPNDITLNNSVALDPIDISIELNKAKSDLEESKEW

SEQ ID NO: 188 - protein, 35 aa, Artificial Sequence
  Core polypeptide
PNDITLNNSVALDPIDISIELNKAKSDLEESKEWI

SEQ ID NO: 189 - protein, 35 aa, Artificial Sequence
  Core polypeptide
NDITLNNSVALDPIDISIELNKAKSDLEESKEWIR

SEQ ID NO: 190 - protein, 35 aa, Artificial Sequence
  Core polypeptide
DITLNNSVALDPIDISIELNKAKSDLEESKEWIRR

SEQ ID NO: 191 - protein, 35 aa, Artificial Sequence
  Core polypeptide
ITLNNSVALDPIDISIELNKAKSDLEESKEWIRRS

SEQ ID NO: 192 - protein, 35 aa, Artificial Sequence
  Core polypeptide
TLNNSVALDPIDISIELNKAKSDLEESKEWIRRSN

SEQ ID NO: 193 - protein, 35 aa, Artificial Sequence
  Core polypeptide
LNNSVALDPIDISIELNKAKSDLEESKEWIRRSNQ

SEQ ID NO: 194 - protein, 35 aa, Artificial Sequence
  Core polypeptide
NNSVALDPIDISIELNKAKSDLEESKEWIRRSNQK

SEQ ID NO: 195 - protein, 35 aa, Artificial Sequence
  Core polypeptide
NSVALDPIDISIELNKAKSDLEESKEWIRRSNQKL

SEQ ID NO: 196 - protein, 35 aa, Artificial Sequence
  Core polypeptide
SVALDPIDISIELNKAKSDLEESKEWIRRSNQKLD

SEQ ID NO: 197 - protein, 35 aa, Artificial Sequence
  Core polypeptide
VALDPIDISIELNKAKSDLEESKEWIRRSNQKLDS

SEQ ID NO: 198 - protein, 35 aa, Artificial Sequence
  Core polypeptide
ALDPIDISIELNKAKSDLEESKEWIRRSNQKLDSI

SEQ ID NO: 199 - protein, 35 aa, Artificial Sequence
  Core polypeptide
LDPIDISIELNKAKSDLEESKEWIRRSNQKLDSIG

SEQ ID NO: 200 - protein, 35 aa, Artificial Sequence
  Core polypeptide
DPIDISIELNKAKSDLEESKEWIRRSNQKLDSIGN

SEQ ID NO: 201 - protein, 35 aa, Artificial Sequence
  Core polypeptide
PIDISIELNKAKSDLEESKEWIRRSNQKLDSIGNW

SEQ ID NO: 202 - protein, 35 aa, Artificial Sequence
  Core polypeptide
IDISIELNKAKSDLEESKEWIRRSNQKLDSIGNWH

SEQ ID NO: 203 - protein, 35 aa, Artificial Sequence
  Core polypeptide
DISIELNKAKSDLEESKEWIRRSNQKLDSIGNWHQ

SEQ ID NO: 204 - protein, 35 aa, Artificial Sequence
  Core polypeptide
ISIELNKAKSDLEESKEWIRRSNQKLDSIGNWHQS

SEQ ID NO: 205 - protein, 35 aa, Artificial Sequence
  Core polypeptide
SIELNKAKSDLEESKEWIRRSNQKLDSIGNWHQSS

SEQ ID NO: 206 - protein, 35 aa, Artificial Sequence
  Core polypeptide
IELNKAKSDLEESKEWIRRSNQKLDSIGNWHQSST

SEQ ID NO: 207 - protein, 35 aa, Artificial Sequence
  Core polypeptide
ELNKAKSDLEESKEWIRRSNQKLDSIGNWHQSSTT

SEQ ID NO: 208 - protein, 36 aa, Artificial Sequence
  Core polypeptide
ELRALRGELRALRGELRALRGELRALRGELRALRGK

SEQ ID NO: 209 - protein, 36 aa, Artificial Sequence
  Core polypeptide
YTSLIHSLIEESQNQQQKNEQELLELDKWASLWNWF

SEQ ID NO: 210 - protein, 36 aa, Artificial Sequence
  Core polypeptide
YTSLIHSLIEESQNQQEKNEQELLELNKWASLWNWF

SEQ ID NO: 211 - protein, 36 aa, Artificial Sequence
  Core polypeptide
YTSLIHSLIEQSQNQQEKNEQELLELDKWASLWNWF

SEQ ID NO: 212 - protein, 36 aa, Artificial Sequence
  Core polypeptide
YTSLIHSLIQESQNQQEKNEQELLELDKWASLWNWF

SEQ ID NO: 213 - protein, 36 aa, Artificial Sequence
  Core polypeptide
YTSLIHSLIQQSQNQQQKNQQQLLQLNKWASLWNWF

SEQ ID NO: 214 - protein, 17 aa, Artificial Sequence
  Core polypeptide
EQELLELDKWASLWNWF

SEQ ID NO: 215 - protein, 16 aa, Artificial Sequence
  Core polypeptide
QELLELDKWASLWNWF

SEQ ID NO: 216 - protein, 15 aa, Artificial Sequence
  Core polypeptide
ELLELDKWASLWNWF

SEQ ID NO: 217 - protein, 14 aa, Artificial Sequence
  Core polypeptide
LLELDKWASLWNWF

SEQ ID NO: 218 - protein, 13 aa, Artificial Sequence
  Core polypeptide
LELDKWASLWNWF

SEQ ID NO: 219 - protein, 12 aa, Artificial Sequence
  Core polypeptide
ELDKWASLWNWF

SEQ ID NO: 220 - protein, 11 aa, Artificial Sequence
  Core polypeptide
LDKWASLWNWF

SEQ ID NO: 221 - protein, 10 aa, Artificial Sequence
  Core polypeptide
DKWASLWNWF

SEQ ID NO: 222 - protein, 9 aa, Artificial Sequence
  Core polypeptide
KWASLWNWF

SEQ ID NO: 223 - protein, 8 aa, Artificial Sequence
  Core polypeptide
WASLWNWF

SEQ ID NO: 224 - protein, 7 aa, Artificial Sequence
  Core polypeptide
ASLWNWF

SEQ ID NO: 225 - protein, 18 aa, Artificial Sequence
  Core polypeptide
YTSLIHSLIEESQNQQEK

SEQ ID NO: 226 - protein, 36 aa, Artificial Sequence
  Core polypeptide
YTSLIHSLIEESQNQQEKNEQELLELDKWASLANAA

SEQ ID NO: 227 - protein, 36 aa, Artificial Sequence
  Core polypeptide
YTSLIHSLIEESQNQQEKNEQQLLELDKWASLWNWF

SEQ ID NO: 228 - protein, 36 aa, Artificial Sequence
  Core polypeptide
YTSLIQSLIEESQNQQEKNQQELLELDKWASLWNWF

SEQ ID NO: 229 - protein, 14 aa, Artificial Sequence
  Core polypeptide
CLELDKWASLWNWF

SEQ ID NO: 230 - protein, 13 aa, Artificial Sequence
  Core polypeptide
LELDKFASLFNFF

SEQ ID NO: 231 - protein, 28 aa, Artificial Sequence
  Core polypeptide
EAAAREAAAREAAARLELDKWASLWNWF

SEQ ID NO: 232 - protein, 28 aa, Artificial Sequence
  Core polypeptide
RMKQLEDKVEELLSKLELDKWASLWNWF

SEQ ID NO: 233 - protein, 35 aa, Artificial Sequence
  Core polypeptide
PSLRDPISAEISIQALSYALGGDINKVLEKLGYSG

SEQ ID NO: 234 - protein, 35 aa, Artificial Sequence
  Core polypeptide
SLRDPISAEISIQALSYALGGDINKVLEKLGYSGG

SEQ ID NO: 235 - protein, 35 aa, Artificial Sequence
  Core polypeptide
LRDPISAEISIQALSYALGGDINKVLEKLGYSGGD

SEQ ID NO: 236 - protein, 35 aa, Artificial Sequence
  Core polypeptide
RDPISAEISIQALSYALGGDINKVLEKLGYSGGDL

SEQ ID NO: 237 - protein, 35 aa, Artificial Sequence
  Core polypeptide
DPISAEISIQALSYALGGDINKVLEKLGYSGGDLL

SEQ ID NO: 238 - protein, 35 aa, Artificial Sequence
  Core polypeptide
PISAEISIQALSYALGGDINKVLEKLGYSGGDLLG

SEQ ID NO: 239 - protein, 35 aa, Artificial Sequence
  Core polypeptide
ISAEISIQALSYALGGDINKVLEKLGYSGGDLLGI

SEQ ID NO: 240 - protein, 35 aa, Artificial Sequence
  Core polypeptide
SAEISIQALSYALGGDINKVLEKLGYSGGDLLGIL

SEQ ID NO: 241 - protein, 35 aa, Artificial Sequence
  Core polypeptide
AEISIQALSYALGGDINKVLEKLGYSGGDLLGILE

SEQ ID NO: 242 - protein, 35 aa, Artificial Sequence
  Core polypeptide
EISIQALSYALGGDINKVLEKLGYSGGDLLGILES

SEQ ID NO: 243 - protein, 35 aa, Artificial Sequence
  Core polypeptide
ISIQALSYALGGDINKVLEKLGYSGGDLLGILESR

SEQ ID NO: 244 - protein, 35 aa, Artificial Sequence
  Core polypeptide
SIQALSYALGGDINKVLEKLGYSGGDLLGILESRG

SEQ ID NO: 245 - protein, 35 aa, Artificial Sequence
  Core polypeptide
IQALSYALGGDINKVLEKLGYSGGDLLGILESRGI

SEQ ID NO: 246 - protein, 35 aa, Artificial Sequence
  Core polypeptide
QALSYALGGDINKVLEKLGYSGGDLLGILESRGIK

SEQ ID NO: 247 - protein, 35 aa, Artificial Sequence
  Core polypeptide
ALSYALGGDINKVLEKLGYSGGDLLGILESRGIKA

SEQ ID NO: 248 - protein, 35 aa, Artificial Sequence
  Core polypeptide
LSYALGGDINKVLEKLGYSGGDLLGILESRGIKAR

SEQ ID NO: 249 - protein, 35 aa, Artificial Sequence
  Core polypeptide
PDAVYLHRIDLGPPISLERLDVGTNLGNAIAKLED

SEQ ID NO: 250 - protein, 35 aa, Artificial Sequence
  Core polypeptide
DAVYLHRIDLGPPISLERLDVGTNLGNAIAKLEDA

SEQ ID NO: 251 - protein, 35 aa, Artificial Sequence
  Core polypeptide
AVYLHRIDLGPPISLERLDVGTNLGNAIAKLEDAK

SEQ ID NO: 252 - protein, 35 aa, Artificial Sequence
  Core polypeptide
VYLHRIDLGPPISLERLDVGTNLGNAIAKLEDAKE

SEQ ID NO: 253 - protein, 35 aa, Artificial Sequence
  Core polypeptide
YLHRIDLGPPISLERLDVGTNLGNAIAKLEDAKEL

SEQ ID NO: 254 - protein, 35 aa, Artificial Sequence
  Core polypeptide
LHRIDLGPPISLERLDVGTNLGNAIAKLEDAKELL

SEQ ID NO: 255 - protein, 35 aa, Artificial Sequence
  Core polypeptide
HRIDLGPPISLERLDVGTNLGNAIAKLEDAKELLE

SEQ ID NO: 256 - protein, 35 aa, Artificial Sequence
  Core polypeptide
RIDLGPPISLERLDVGTNLGNAIAKLEDAKELLES

SEQ ID NO: 257 - protein, 35 aa, Artificial Sequence
  Core polypeptide
IDLGPPISLERLDVGTNLGNAIAKLEDAKELLESS

SEQ ID NO: 258 - protein, 35 aa, Artificial Sequence
  Core polypeptide
DLGPPISLERLDVGTNLGNAIAKLEDAKELLESSD

SEQ ID NO: 259 - protein, 35 aa, Artificial Sequence
  Core polypeptide
LGPPISLERLDVGTNLGNAIAKLEDAKELLESSDQ

SEQ ID NO: 260 - protein, 35 aa, Artificial Sequence
  Core polypeptide
GPPISLERLDVGTNLGNAIAKLEDAKELLESSDQI

SEQ ID NO: 261 - protein, 35 aa, Artificial Sequence
  Core polypeptide
PPISLERLDVGTNLGNAIAKLEDAKELLESSDQIL

SEQ ID NO: 262 - protein, 35 aa, Artificial Sequence
  Core polypeptide
PISLERLDVGTNLGNAIAKLEDAKELLESSDQILR

SEQ ID NO: 263 - protein, 34 aa, Artificial Sequence
  Core polypeptide
ISLERLDVGTNLGNAIAKLEDAKELLESSDQIRS

SEQ ID NO: 264 - protein, 35 aa, Artificial Sequence
  Core polypeptide
SLERLDVGTNLGNAIAKLEDAKELLESSDQILRSM

SEQ ID NO: 265 - protein, 35 aa, Artificial Sequence
  Core polypeptide
LERLDVGTNLGNAIAKLEDAKELLESSDQILRSMK

SEQ ID NO: 266 - protein, 13 aa, Artificial Sequence
  Core polypeptide
EWIRRSNQKLDSI

SEQ ID NO: 267 - protein, 13 aa, Artificial Sequence
  Core polypeptide
LELDKWASLANAF

SEQ ID NO: 268 - protein, 13 aa, Artificial Sequence
  Core polypeptide
LELDKWASLFNFF

SEQ ID NO: 269 - protein, 13 aa, Artificial Sequence
  Core polypeptide
LELDKWASLANWF

SEQ ID NO: 270 - protein, 13 aa, Artificial Sequence
  Core polypeptide
LELDKWASLWNAF

SEQ ID NO: 271 - protein, 35 aa, Artificial Sequence
  Core polypeptide
ELGNVNNSISNALDKLEESNSKLDKVNVKLTSTSA

SEQ ID NO: 272 - protein, 35 aa, Artificial Sequence
  Core polypeptide
TELGNVNNSISNALDKLEESNSKLDKVNVKLTSTS

SEQ ID NO: 273 - protein, 35 aa, Artificial Sequence
  Core polypeptide
STELGNVNNSISNALDKLEESNSKLDKVNVKLTST

SEQ ID NO: 274 - protein, 35 aa, Artificial Sequence
  Core polypeptide
ISTELGNVNNSISNALDKLEESNSKLDKVNVKLTS

SEQ ID NO: 275 - protein, 35 aa, Artificial Sequence
  Core polypeptide
DISTELGNVNNSISNALDKLEESNSKLDKVNVKLT

SEQ ID NO: 276 - protein, 35 aa, Artificial Sequence
  Core polypeptide
LDISTELGNVNNSISNALDKLEESNSKLDKVNVKL

SEQ ID NO: 277 - protein, 35 aa, Artificial Sequence
  Core polypeptide
NLDISTELGNVNNSISNALDKLEESNSKLDKVNVK

SEQ ID NO: 278 - protein, 35 aa, Artificial Sequence
  Core polypeptide
GNLDISTELGNVNNSISNALDKLEESNSKLDKVNV

SEQ ID NO: 279 - protein, 35 aa, Artificial Sequence
  Core polypeptide
TGNLDISTELGNVNNSISNALDKLEESNSKLDKVN

SEQ ID NO: 280 - protein, 35 aa, Artificial Sequence
  Core polypeptide
VTGNLDISTELGNVNNSISNALDKLEESNSKLDKV

SEQ ID NO: 281 - protein, 35 aa, Artificial Sequence
  Core polypeptide
IVTGNLDISTELGNVNNSISNALDKLEESNSKLDK

SEQ ID NO: 282 - protein, 35 aa, Artificial Sequence
  Core polypeptide
VIVTGNLDISTELGNVNNSISNALDKLEESNSKLD

SEQ ID NO: 283 - protein, 35 aa, Artificial Sequence
  Core polypeptide
QVIVTGNLDISTELGNVNNSISNALDKLEESNSKL

SEQ ID NO: 284 - protein, 35 aa, Artificial Sequence
  Core polypeptide
SQVIVTGNLDISTELGNVNNSISNALDKLEESNSK

SEQ ID NO: 285 - protein, 35 aa, Artificial Sequence
  Core polypeptide
DSQVIVTGNLDISTELGNVNNSISNALDKLEESNS

SEQ ID NO: 286 - protein, 35 aa, Artificial Sequence
  Core polypeptide
LDSQVIVTGNLDISTELGNVNNSISNALDKLEESN

SEQ ID NO: 287 - protein, 35 aa, Artificial Sequence
  Core polypeptide
ILDSQVIVTGNLDISTELGNVNNSISNALDKLEES

SEQ ID NO: 288 - protein, 35 aa, Artificial Sequence
  Core polypeptide
SILDSQVIVTGNLDISTELGNVNNSISNALDKLEE

SEQ ID NO: 289 - protein, 35 aa, Artificial Sequence
  Core polypeptide
ISILDSQVIVTGNLDISTELGNVNNSISNALDKLE

SEQ ID NO: 290 - protein, 35 aa, Artificial Sequence
  Core polypeptide
NISILDSQVIVTGNLDISTELGNVNNSISNALDKL

SEQ ID NO: 291 - protein, 35 aa, Artificial Sequence
  Core polypeptide
KNISILDSQVIVTGNLDISTELGNVNNSISNALDK

SEQ ID NO: 292 - protein, 35 aa, Artificial Sequence
  Core polypeptide
QKNISILDSQVIVTGNLDISTELGNVNNSISNALD

SEQ ID NO: 293 - protein, 35 aa, Artificial Sequence
  Core polypeptide
YQKNISILDSQVIVTGNLDISTELGNVNNSISNAL

SEQ ID NO: 294 - protein, 35 aa, Artificial Sequence
  Core polypeptide
TYQKNISILDSQVIVTGNLDISTELGNVNNSISNA

SEQ ID NO: 295 - protein, 35 aa, Artificial Sequence
  Core polypeptide
ATYQKNISILDSQVIVTGNLDISTELGNVNNSISN

SEQ ID NO: 296 - protein, 35 aa, Artificial Sequence
  Core polypeptide
DATYQKNISILDSQVIVTGNLDISTELGNVNNSIS

SEQ ID NO: 297 - protein, 35 aa, Artificial Sequence
  Core polypeptide
FDATYQKNISILDSQVIVTGNLDISTELGNVNNSI

SEQ ID NO: 298 - protein, 35 aa, Artificial Sequence
  Core polypeptide
EFDATYQKNISILDSQVIVTGNLDISTELGNVNNS

SEQ ID NO: 299 - protein, 35 aa, Artificial Sequence
  Core polypeptide
GEFDATYQKNISILDSQVIVTGNLDISTELGNVNN

SEQ ID NO: 300 - protein, 35 aa, Artificial Sequence
  Core polypeptide
SGEFDATYQKNISILDSQVIVTGNLDISTELGNVN

SEQ ID NO: 301 - protein, 35 aa, Artificial Sequence
  Core polypeptide
LSGEFDATYQKNISILDSQVIVTGNLDISTELGNV

SEQ ID NO: 302 - protein, 35 aa, Artificial Sequence
  Core polypeptide
RLSGEFDATYQKNISILDSQVIVTGNLDISTELGN

SEQ ID NO: 303 - protein, 35 aa, Artificial Sequence
  Core polypeptide
LRLSGEFDATYQKNISILDSQVIVTGNLDISTELG

SEQ ID NO: 304 - protein, 35 aa, Artificial Sequence
  Core polypeptide
TLRLSGEFDATYQKNISILDSQVIVTGNLDISTEL

SEQ ID NO: 305 - protein, 35 aa, Artificial Sequence
  Core polypeptide
ITLRLSGEFDATYQKNISILDSQVIVTGNLDISTE

SEQ ID NO: 306 - protein, 35 aa, Artificial Sequence
  Core polypeptide
GITLRLSGEFDATYQKNISILDSQVIVTGNLDIST

SEQ ID NO: 307 - protein, 35 aa, Artificial Sequence
  Core polypeptide
TATIEAVHEVTDGLSQLAVAVGKMQQFVNDQFNNT

SEQ ID NO: 308 - protein, 35 aa, Artificial Sequence
  Core polypeptide
ITATIEAVHEVTDGLSQLAVAVGKMQQFVNDQFNN

SEQ ID NO: 309 - protein, 35 aa, Artificial Sequence
  Core polypeptide
SITATIEAVHEVTDGLSQLAVAVGKMQQFVNDQFN

SEQ ID NO: 310 - protein, 35 aa, Artificial Sequence
  Core polypeptide
KESITATIEAVHEVTDGLSQLAVAVGKMQQFVNDQ

SEQ ID NO: 311 - protein, 35 aa, Artificial Sequence
  Core polypeptide
LKESITATIEAVHEVTDGLSQLAVAVGKMQQFVND

SEQ ID NO: 312 - protein, 35 aa, Artificial Sequence
  Core polypeptide
RLKESITATIEAVHEVTDGLSQLAVAVGKMQQFVN

SEQ ID NO: 313 - protein, 35 aa, Artificial Sequence
  Core polypeptide
LRLKESITATIEAVHEVTDGLSQLAVAVGKMQQFV

SEQ ID NO: 314 - protein, 35 aa, Artificial Sequence
  Core polypeptide
ILRLKESITATIEAVHEVTDGLSQLAVAVGKMQQF

SEQ ID NO: 315 - protein, 35 aa, Artificial Sequence
  Core polypeptide
NILRLKESITATIEAVHEVTDGLSQLAVAVGKMQQ

SEQ ID NO: 316 - protein, 35 aa, Artificial Sequence
  Core polypeptide
ANILRLKESITATIEAVHEVTDGLSQLAVAVGKMQ

SEQ ID NO: 317 - protein, 35 aa, Artificial Sequence
  Core polypeptide
AANILRLKESITATIEAVHEVTDGLSQLAVAVGKM

SEQ ID NO: 318 - protein, 35 aa, Artificial Sequence
  Core polypeptide
HKCDDECMNSVKNGTYDYPKYEEESKLNRNEIKGV

SEQ ID NO: 319 - protein, 35 aa, Artificial Sequence
  Core polypeptide
KCDDECMNSVKNGTYDYPKYEEESKLNRNEIKGVK

SEQ ID NO: 320 - protein, 35 aa, Artificial Sequence
  Core polypeptide
CDDECMNSVKNGTYDYPKYEEESKLNRNEIKGVKL

SEQ ID NO: 321 - protein, 35 aa, Artificial Sequence
  Core polypeptide
DDECMNSVKNGTYDYPKYEEESKLNRNEIKGVKLS

SEQ ID NO: 322 - protein, 35 aa, Artificial Sequence
  Core polypeptide
DECMNSVKNGTYDYPKYEEESKLNRNEIKGVKLSS

SEQ ID NO: 323 - protein, 35 aa, Artificial Sequence
  Core polypeptide
ECMNSVKNGTYDYPKYEEESKLNRNEIKGVKLSSM

SEQ ID NO: 324 - protein, 35 aa, Artificial Sequence
  Core polypeptide
CMNSVKNGTYDYPKYEEESKLNRNEIKGVKLSSMG

SEQ ID NO: 325 - protein, 35 aa, Artificial Sequence
  Core polypeptide
MNSVKNGTYDYPKYEEESKLNRNEIKGVKLSSMGV

SEQ ID NO: 326 - protein, 35 aa, Artificial Sequence
  Core polypeptide
NSVKNGTYDYPKYEEESKLNRNEIKGVKLSSMGVY

SEQ ID NO: 327 - protein, 35 aa, Artificial Sequence
  Core polypeptide
SVKNGTYDYPKYEEESKLNRNEIKGVKLSSMGVYQ

SEQ ID NO: 328 - protein, 35 aa, Artificial Sequence
  Core polypeptide
VKNGTYDYPKYEEESKLNRNEIKGVKLSSMGVYQI

SEQ ID NO: 329 - protein, 35 aa, Artificial Sequence
  Core polypeptide
KNGTYDYPKYEEESKLNRNEIKGVKLSSMGVYQIL

SEQ ID NO: 330 - protein, 13 aa, Artificial Sequence
  Core polypeptide
AFIRKSDELLHNV

SEQ ID NO: 331 - protein, 35 aa, Artificial Sequence
  Core polypeptide
VVLAGAALGVATAAQITAGIALHQSMLNSQAIDNL

SEQ ID NO: 332 - protein, 35 aa, Artificial Sequence
  Core polypeptide
VLAGAALGVATAAQITAGIALHQSMLNSQAIDNLR

SEQ ID NO: 333 - protein, 35 aa, Artificial Sequence
  Core polypeptide
LAGAALGVATAAQITAGIALHQSMLNSQAIDNLRA

SEQ ID NO: 334 - protein, 35 aa, Artificial Sequence
  Core polypeptide
AGAALGVATAAQITAGIALHQSMLNSQAIDNLRAS

SEQ ID NO: 335 - protein, 35 aa, Artificial Sequence
  Core polypeptide
GAALGVATAAQITAGIALHQSMLNSQAIDNLRASL

SEQ ID NO: 336 - protein, 35 aa, Artificial Sequence
  Core polypeptide
AALGVATAAQITAGIALHQSMLNSQAIDNLRASLE

SEQ ID NO: 337 - protein, 35 aa, Artificial Sequence
  Core polypeptide
ALGVATAAQITAGIALHQSMLNSQAIDNLRASLET

SEQ ID NO: 338 - protein, 35 aa, Artificial Sequence
  Core polypeptide
LGVATAAQITAGIALHQSMLNSQAIDNLRASLETT

SEQ ID NO: 339 - protein, 35 aa, Artificial Sequence
  Core polypeptide
GVATAAQITAGIALHQSMLNSQAIDNLRASLETTN

SEQ ID NO: 340 - protein, 35 aa, Artificial Sequence
  Core polypeptide
VATAAQITAGIALHQSMLNSQAIDNLRASLETTNQ

SEQ ID NO: 341 - protein, 35 aa, Artificial Sequence
  Core polypeptide
ATAAQITAGIALHQSMLNSQAIDNLRASLETTNQA

SEQ ID NO: 342 - protein, 35 aa, Artificial Sequence
  Core polypeptide
TAAQITAGIALHQSMLNSQAIDNLRASLETTNQAI

SEQ ID NO: 343 - protein, 35 aa, Artificial Sequence
  Core polypeptide
AAQITAGIALHQSMLNSQAIDNLRASLETTNQAIE

SEQ ID NO: 344 - protein, 35 aa, Artificial Sequence
  Core polypeptide
AQITAGIALHQSMLNSQAIDNLRASLETTNQAIEA

SEQ ID NO: 345 - protein, 35 aa, Artificial Sequence
  Core polypeptide
QITAGIALHQSMLNSQAIDNLRASLETTNQAIEAI

SEQ ID NO: 346 - protein, 35 aa, Artificial Sequence
  Core polypeptide
ITAGIALHQSMLNSQAIDNLRASLETTNQAIEAIR

SEQ ID NO: 347 - protein, 35 aa, Artificial Sequence
  Core polypeptide
TAGIALHQSMLNSQAIDNLRASLETTNQAIEAIRQ

SEQ ID NO: 348 - protein, 35 aa, Artificial Sequence
  Core polypeptide
AGIALHQSMLNSQAIDNLRASLETTNQAIEAIRQA

SEQ ID NO: 349 - protein, 35 aa, Artificial Sequence
  Core polypeptide
GIALHQSMLNSQAIDNLRASLETTNQAIEAIRQAG

SEQ ID NO: 350 - protein, 35 aa, Artificial Sequence
  Core polypeptide
IALHQSMLNSQAIDNLRASLETTNQAIEAIRQAGQ

SEQ ID NO: 351 - protein, 35 aa, Artificial Sequence
  Core polypeptide
ALHQSMLNSQAIDNLRASLETTNQAIEAIRQAGQE

SEQ ID NO: 352 - protein, 35 aa, Artificial Sequence
  Core polypeptide
LHQSMLNSQAIDNLRASLETTNQAIEAIRQAGQEM

SEQ ID NO: 353 - protein, 35 aa, Artificial Sequence
  Core polypeptide
HQSMLNSQAIDNLRASLETTNQAIEAIRQAGQEMI

SEQ ID NO: 354 - protein, 35 aa, Artificial Sequence
  Core polypeptide
QSMLNSQAIDNLRASLETTNQAIEAIRQAGQEMIL

SEQ ID NO: 355 - protein, 35 aa, Artificial Sequence
  Core polypeptide
SMLNSQAIDNLRASLETTNQAIEAIRQAGQEMILA

SEQ ID NO: 356 - protein, 35 aa, Artificial Sequence
  Core polypeptide
MLNSQAIDNLRASLETTNQAIEAIRQAGQEMILAV

SEQ ID NO: 357 - protein, 35 aa, Artificial Sequence
  Core polypeptide
LNSQAIDNLRASLETTNQAIEAIRQAGQEMILAVQ

SEQ ID NO: 358 - protein, 35 aa, Artificial Sequence
  Core polypeptide
NSQAIDNLRASLETTNQAIEAIRQAGQEMILAVQG

SEQ ID NO: 359 - protein, 35 aa, Artificial Sequence
  Core polypeptide
SQAIDNLRASLETTNQAIEAIRQAGQEMILAVQGV

SEQ ID NO: 360 - protein, 35 aa, Artificial Sequence
  Core polypeptide
QAIDNLRASLETTNQAIEAIRQAGQEMILAVQGVQ

SEQ ID NO: 361 - protein, 35 aa, Artificial Sequence
  Core polypeptide
AIDNLRASLETTNQAIEAIRQAGQEMILAVQGVQD

SEQ ID NO: 362 - protein, 35 aa, Artificial Sequence
  Core polypeptide
IDNLRASLETTNQAIEAIRQAGQEMILAVQGVQDY

SEQ ID NO: 363 - protein, 35 aa, Artificial Sequence
  Core polypeptide
DNLRASLETTNQAIEAIRQAGQEMILAVQGVQDYI

SEQ ID NO: 364 - protein, 35 aa, Artificial Sequence
  Core polypeptide
NLRASLETTNQAIEAIRQAGQEMILAVQGVQDYIN

SEQ ID NO: 365 - protein, 35 aa, Artificial Sequence
  Core polypeptide
LRASLETTNQAIEAIRQAGQEMILAVQGVQDYINN

SEQ ID NO: 366 - protein, 35 aa, Artificial Sequence
  Core polypeptide
RASLETTNQAIEAIRQAGQEMILAVQGVQDYINNE

SEQ ID NO: 367 - protein, 33 aa, Artificial Sequence
  Core polypeptide
YTSVITIELSNIKENKNGTDAVKLIKQELDKYK

SEQ ID NO: 368 - protein, 33 aa, Artificial Sequence
  Core polypeptide
TSVITIELSNIKENKNGTDAVKLIKQELDKYKN

SEQ ID NO: 369 - protein, 33 aa, Artificial Sequence
  Core polypeptide
SVITIELSNIKENKNGTDAVKLIKQELDKYKNA

SEQ ID NO: 370 - protein, 34 aa, Artificial Sequence
  Core polypeptide
SNIKENKNGTDAKVKLIKQELDKYKNAVTELQLL

SEQ ID NO: 371 - protein, 34 aa, Artificial Sequence
  Core polypeptide
KENKNGTDAKVKLIKQELDKYKNAVTELQLLMQS

SEQ ID NO: 372 - protein, 15 aa, Artificial Sequence
  Core polypeptide
CLELDKWASLWNWFC

SEQ ID NO: 373 - protein, 15 aa, Artificial Sequence
  Core polypeptide
CLELDKWASLANWFC

SEQ ID NO: 374 - protein, 15 aa, Artificial Sequence
  Core polypeptide
CLELDKWASLFNFFC

SEQ ID NO: 375 - protein, 36 aa, Artificial Sequence
  Core polypeptide
YTSLIHSLIEESQNQQEKNEQELLELDKWASLFNFF

SEQ ID NO: 376 - protein, 35 aa, Artificial Sequence
  Core polypeptide
RMKQLEDKVEELLSKNYHLENELELDKWASLWNWF

SEQ ID NO: 377 - protein, 28 aa, Artificial Sequence
  Core polypeptide
KVEELLSKNYHLENELELDKWASLWNWF

SEQ ID NO: 378 - protein, 29 aa, Artificial Sequence
  Core polypeptide
RMKQLEDKVEELLSKLEWIRRSNQKLDSI

SEQ ID NO: 379 - protein, 29 aa, Artificial Sequence
  Core polypeptide
RMKQLEDKVEELLSKLAFIRKSDELLHNV

SEQ ID NO: 380 - protein, 28 aa, Artificial Sequence
  Core polypeptide
ELEALRGELRALRGELELDKWASLWNWF

SEQ ID NO: 381 - protein, 34 aa, Artificial Sequence
  Core polypeptide
LDPIDISIELNKAKSDLEESKEWIRRSNQKLDSI

SEQ ID NO: 382 - protein, 16 aa, Artificial Sequence
  Core polypeptide
CNEQLSDSFPVEFFQV

SEQ ID NO: 383 - protein, 21 aa, Artificial Sequence
  Core polypeptide
MAEDDPYLGRPEQMFHLDPSL

SEQ ID NO: 384 - protein, 20 aa, Artificial Sequence
  Core polypeptide
EDFSSIADMDFSALLSQISS

SEQ ID NO: 385 - protein, 35 aa, Artificial Sequence
  Core polypeptide
TWQEWERKVDFLEENITALLEEAQIQQEKNMYELQ

SEQ ID NO: 386 - protein, 35 aa, Artificial Sequence
  Core polypeptide
WQEWERKVDFLEENITALLEEAQIQQEKNMYELQK

SEQ ID NO: 387 - protein, 35 aa, Artificial Sequence
  Core polypeptide
QEWERKVDFLEENITALLEEAQIQQEKNMYELQKL

SEQ ID NO: 388 - protein, 35 aa, Artificial Sequence
  Core polypeptide
EWERKVDFLEENITALLEEAQIQQEKNMYELQKLN

SEQ ID NO: 389 - protein, 35 aa, Artificial Sequence
  Core polypeptide
WERKVDFLEENITALLEEAQIQQEKNMYELQKLNS

SEQ ID NO: 390 - protein, 35 aa, Artificial Sequence
  Core polypeptide
ERKVDFLEENITALLEEAQIQQEKNMYELQKLNSW

SEQ ID NO: 391 - protein, 35 aa, Artificial Sequence
  Core polypeptide
RKVDFLEENITALLEEAQIQQEKNMYELQKLNSWD

SEQ ID NO: 392 - protein, 35 aa, Artificial Sequence
  Core polypeptide
KVDFLEENITALLEEAQIQQEKNMYELQKLNSWDV

SEQ ID NO: 393 - protein, 35 aa, Artificial Sequence
  Core polypeptide
VDFLEENITALLEEAQIQQEKNMYELQKLNSWDVF

SEQ ID NO: 394 - protein, 35 aa, Artificial Sequence
  Core polypeptide
DFLEENITALLEEAQIQQEKNMYELQKLNSWDVFG

SEQ ID NO: 395 - protein, 35 aa, Artificial Sequence
  Core polypeptide
FLEENITALLEEAQIQQEKNMYELQKLNSWDVFGN

SEQ ID NO: 396 - protein, 35 aa, Artificial Sequence
  Core polypeptide
LEENITALLEEAQIQQEKNMYELQKLNSWDVFGNW

SEQ ID NO: 397 - protein, 36 aa, Artificial Sequence
  Core polypeptide
LEENITALLEEAQIQQEKNMYELQKLNSWDVFGNWF

SEQ ID NO: 398 - protein, 36 aa, Artificial Sequence
  Core polypeptide
NEQSEEKENELYWAKEQLLDLLFNIFNQTVGAWIMQ

SEQ ID NO: 399 - protein, 33 aa, Artificial Sequence
  Core polypeptide
EWERKVDFLEENITALLEEAQIQQEKNMYEGGC

SEQ ID NO: 400 - protein, 38 aa, Artificial Sequence
  Core polypeptide
QQQLLDVVKRQQELLRLTVWGTKNLQTRVTAIEKYLKD

SEQ ID NO: 401 - protein, 38 aa, Artificial Sequence
  Core polypeptide
QQLLDVVKRQQELLRLTVWGTKNLQTRVTAIEKYLKDQ

SEQ ID NO: 402 - protein, 38 aa, Artificial Sequence
  Core polypeptide
QQLLDVVKRQQELLRLTVWGPKNLQTRVTAIEKYLKDQ

SEQ ID NO: 403 - protein, 38 aa, Artificial Sequence
  Core polypeptide
DERKQDKVLVVQQTGTLQLTLIQLEKTAKLQWVRLNRY

SEQ ID NO: 404 - protein, 35 aa, Artificial Sequence
  Core polypeptide
QQQLLDVVKRQQELLRLTVWGTKNLQTRVTAIEKY

SEQ ID NO: 405 - protein, 35 aa, Artificial Sequence
  Core polypeptide
QQLLDVVKRQQELLRLTVWGTKNLQTRVTAIEKYL

SEQ ID NO: 406 - protein, 35 aa, Artificial Sequence
  Core polypeptide
QLLDVVKRQQELLRLTVWGTKNLQTRVTAIEKYLK

SEQ ID NO: 407 - protein, 35 aa, Artificial Sequence
  Core polypeptide
LLDVVKRQQELLRLTVWGTKNLQTRVTAIEKYLKD

SEQ ID NO: 408 - protein, 35 aa, Artificial Sequence
  Core polypeptide
LDVVKRQQELLRLTVWGTKNLQTRVTAIEKYLKDQ

SEQ ID NO: 409 - protein, 35 aa, Artificial Sequence
  Core polypeptide
DVVKRQQELLRLTVWGTKNLQTRVTAIEKYLKDQA

SEQ ID NO: 410 - protein, 35 aa, Artificial Sequence
  Core polypeptide
VVKRQQELLRLTVWGTKNLQTRVTAIEKYLKDQAQ

SEQ ID NO: 411 - protein, 35 aa, Artificial Sequence
  Core polypeptide
VKRQQELLRLTVWGTKNLQTRVTAIEKYLKDQAQL

SEQ ID NO: 412 - protein, 35 aa, Artificial Sequence
  Core polypeptide
KRQQELLRLTVWGTKNLQTRVTAIEKYLKDQAQLN

SEQ ID NO: 413 - protein, 35 aa, Artificial Sequence
  Core polypeptide
RQQELLRLTVWGTKNLQTRVTAIEKYLKDQAQLNA

SEQ ID NO: 414 - protein, 35 aa, Artificial Sequence
  Core polypeptide
QQELLRLTVWGTKNLQTRVTAIEKYLKDQAQLNAW

SEQ ID NO: 415 - protein, 35 aa, Artificial Sequence
  Core polypeptide
QELLRLTVWGTKNLQTRVTAIEKYLKDQAQLNAWG

SEQ ID NO: 416 - protein, 35 aa, Artificial Sequence
  Core polypeptide
ELLRLTVWGTKNLQTRVTAIEKYLKDQAQLNAWGC

SEQ ID NO: 417 - protein, 38 aa, Artificial Sequence
  Core polypeptide
NNLLRAIEAQQHLLQLTVWGPKQLQARILAVERYLKDQ

SEQ ID NO: 418 - protein, 35 aa, Artificial Sequence
  Core polypeptide
SELEIKRYKNRVASRKCRAKFKQLLQHYREVAAAK

SEQ ID NO: 419 - protein, 35 aa, Artificial Sequence
  Core polypeptide
ELEIKRYKNRVASRKCRAKFKQLLQHYREVAAAKS

SEQ ID NO: 420 - protein, 35 aa, Artificial Sequence
  Core polypeptide
LEIKRYKNRVASRKCRAKFKQLLQHYREVAAAKSS

SEQ ID NO: 421 - protein, 35 aa, Artificial Sequence
  Core polypeptide
EIKRYKNRVASRKCRAKFKQLLQHYREVAAAKSSE

SEQ ID NO: 422 - protein, 35 aa, Artificial Sequence
  Core polypeptide
IKRYKNRVASRKCRAKFKQLLQHYREVAAAKSSEN

SEQ ID NO: 423 - protein, 35 aa, Artificial Sequence
  Core polypeptide
KRYKNRVASRKCRAKFKQLLQHYREVAAAKSSEND

SEQ ID NO: 424 - protein, 35 aa, Artificial Sequence
  Core polypeptide
RYKNRVASRKCRAKFKQLLQHYREVAAAKSSENDR

SEQ ID NO: 425 - protein, 35 aa, Artificial Sequence
  Core polypeptide
YKNRVASRKCRAKFKQLLQHYREVAAAKSSENDRL

SEQ ID NO: 426 - protein, 35 aa, Artificial Sequence
  Core polypeptide
KNRVASRKCRAKFKQLLQHYREVAAAKSSENDRLR

SEQ ID NO: 427 - protein, 35 aa, Artificial Sequence
  Core polypeptide
NRVASRKCRAKFKQLLQHYREVAAAKSSENDRLRL

SEQ ID NO: 428 - protein, 35 aa, Artificial Sequence
  Core polypeptide
RVASRKCRAKFKQLLQHYREVAAAKSSENDRLRLL

SEQ ID NO: 429 - protein, 35 aa, Artificial Sequence
  Core polypeptide
VASRKCRAKFKQLLQHYREVAAAKSSENDRLRLLL

SEQ ID NO: 430 - protein, 35 aa, Artificial Sequence
  Core polypeptide
ASRKCRAKFKQLLQHYREVAAAKSSENDRLRLLLK

SEQ ID NO: 431 - protein, 35 aa, Artificial Sequence
  Core polypeptide
SRKCRAKFKQLLQHYREVAAAKSSENDRLRLLLKQ

SEQ ID NO: 432 - protein, 35 aa, Artificial Sequence
  Core polypeptide
RKCRAKFKQLLQHYREVAAAKSSENDRLRLLLKQM

SEQ ID NO: 433 - protein, 35 aa, Artificial Sequence
  Core polypeptide
KCRAKFKQLLQHYREVAAAKSSENDRLRLLLKQMC

SEQ ID NO: 434 - protein, 35 aa, Artificial Sequence
  Core polypeptide
CRAKFKQLLQHYREVAAAKSSENDRLRLLLKQMCP

SEQ ID NO: 435 - protein, 35 aa, Artificial Sequence
  Core polypeptide
RAKFKQLLQHYREVAAAKSSENDRLRLLLKQMCPS

SEQ ID NO: 436 - protein, 35 aa, Artificial Sequence
  Core polypeptide
AKFKQLLQHYREVAAAKSSENDRLRLLLKQMCPSL

SEQ ID NO: 437 - protein, 35 aa, Artificial Sequence
  Core polypeptide
KFKQLLQHYREVAAAKSSENDRLRLLLKQMCPSLD

SEQ ID NO: 438 - protein, 35 aa, Artificial Sequence
  Core polypeptide
FKQLLQHYREVAAAKSSENDRLRLLLKQMCPSLDV

SEQ ID NO: 439 - protein, 35 aa, Artificial Sequence
  Core polypeptide
KQLLQHYREVAAAKSSENDRLRLLLKQMCPSLDVD

SEQ ID NO: 440 - protein, 35 aa, Artificial Sequence
  Core polypeptide
QLLQHYREVAAAKSSENDRLRLLLKQMCPSLDVDS

SEQ ID NO: 441 - protein, 35 aa, Artificial Sequence
  Core polypeptide
LLQHYREVAAAKSSENDRLRLLLKQMCPSLDVDSI

SEQ ID NO: 442 - protein, 35 aa, Artificial Sequence
  Core polypeptide
LQHYREVAAAKSSENDRLRLLLKQMCPSLDVDSII

SEQ ID NO: 443 - protein, 35 aa, Artificial Sequence
  Core polypeptide
QHYREVAAAKSSENDRLRLLLKQMCPSLDVDSIIP

SEQ ID NO: 444 - protein, 35 aa, Artificial Sequence
  Core polypeptide
HYREVAAAKSSENDRLRLLLKQMCPSLDVDSIIPR

SEQ ID NO: 445 - protein, 35 aa, Artificial Sequence
  Core polypeptide
YREVAAAKSSENDRLRLLLKQMCPSLDVDSIIPRT

SEQ ID NO: 446 - protein, 35 aa, Artificial Sequence
  Core polypeptide
REVAAAKSSENDRLRLLLKQMCPSLDVDSIIPRTP

SEQ ID NO: 447 - protein, 35 aa, Artificial Sequence
  Core polypeptide
EVAAAKSSENDRLRLLLKQMCPSLDVDSIIPRTPD

SEQ ID NO: 448 - protein, 35 aa, Artificial Sequence
  Core polypeptide
VAAAKSSENDRLRLLLKQMCPSLDVDSIIPRTPDV

SEQ ID NO: 449 - protein, 35 aa, Artificial Sequence
  Core polypeptide
AAAKSSENDRLRLLLKQMCPSLDVDSIIPRTPDVL

SEQ ID NO: 450 - protein, 35 aa, Artificial Sequence
  Core polypeptide
AAKSSENDRLRLLLKQMCPSLDVDSIIPRTPDVLH

SEQ ID NO: 451 - protein, 35 aa, Artificial Sequence
  Core polypeptide
AKSSENDRLRLLLKQMCPSLDVDSIIPRTPDVLHE

SEQ ID NO: 452 - protein, 35 aa, Artificial Sequence
  Core polypeptide
KSSENDRLRLLLKQMCPSLDVDSIIPRTPDVLHED

SEQ ID NO: 453 - protein, 35 aa, Artificial Sequence
  Core polypeptide
SSENDRLRLLLKQMCPSLDVDSIIPRTPDVLHEDL

SEQ ID NO: 454 - protein, 35 aa, Artificial Sequence
  Core polypeptide
SENDRLRLLLKQMCPSLDVDSIIPRTPDVLHEDLL

SEQ ID NO: 455 - protein, 35 aa, Artificial Sequence
  Core polypeptide
ENDRLRLLLKQMCPSLDVDSIIPRTPDVLHEDLLN

SEQ ID NO: 456 - protein, 35 aa, Artificial Sequence
  Core polypeptide
NDRLRLLLKQMCPSLDVDSIIPRTPDVLHEDLLNF

SEQ ID NO: 457 - protein, 35 aa, Artificial Sequence
  Core polypeptide
AAGSTMGARSMTLTVQARQLLSGIVQQQNNLLRAI

SEQ ID NO: 458 - protein, 35 aa, Artificial Sequence
  Core polypeptide
PGYRWMCLRRFIIFLFILLLCLIFLLVLLDYQGML

SEQ ID NO: 459 - protein, 35 aa, Artificial Sequence
  Core polypeptide
GYRWMCLRRFIIFLFILLLCLIFLLVLLDYQGMLP

SEQ ID NO: 460 - protein, 35 aa, Artificial Sequence
  Core polypeptide
YRWMCLRRFIIFLFILLLCLIFLLVLLDYQGMLPV

SEQ ID NO: 461 - protein, 35 aa, Artificial Sequence
  Core polypeptide
RWMCLRRFIIFLFILLLCLIFLLVLLDYQGMLPVC

SEQ ID NO: 462 - protein, 35 aa, Artificial Sequence
  Core polypeptide
WMCLRRFIIFLFILLLCLIFLLVLLDYQGMLPVCP

SEQ ID NO: 463 - protein, 35 aa, Artificial Sequence
  Core polypeptide
MCLRRFIIFLFILLLCLIFLLVLLDYQGMLPVCPL

SEQ ID NO: 464 - protein, 35 aa, Artificial Sequence
  Core polypeptide
CLRRFIIFLFILLLCLIFLLVLLDYQGMLPVCPLI

SEQ ID NO: 465 - protein, 35 aa, Artificial Sequence
  Core polypeptide
LRRFIIFLFILLLCLIFLLVLLDYQGMLPVCPLIP

SEQ ID NO: 466 - protein, 35 aa, Artificial Sequence
  Core polypeptide
RRFIIFLFILLLCLIFLLVLLDYQGMLPVCPLIPG

SEQ ID NO: 467 - protein, 35 aa, Artificial Sequence
  Core polypeptide
RFIIFLFILLLCLIFLLVLLDYQGMLPVCPLIPGS

SEQ ID NO: 468 - protein, 35 aa, Artificial Sequence
  Core polypeptide
FIIFLFILLLCLIFLLVLLDYQGMLPVCPLIPGSS

SEQ ID NO: 469 - protein, 35 aa, Artificial Sequence
  Core polypeptide
IIFLFILLLCLIFLLVLLDYQGMLPVCPLIPGSST

SEQ ID NO: 470 - protein, 35 aa, Artificial Sequence
  Core polypeptide
IFLFILLLCLIFLLVLLDYQGMLPVCPLIPGSSTT

SEQ ID NO: 471 - protein, 35 aa, Artificial Sequence
  Core polypeptide
FLFILLLCLIFLLVLLDYQGMLPVCPLIPGSSTTS

SEQ ID NO: 472 - protein, 35 aa, Artificial Sequence
  Core polypeptide
LFILLLCLIFLLVLLDYQGMLPVCPLIPGSSTTST

SEQ ID NO: 473 - protein, 35 aa, Artificial Sequence
  Core polypeptide
FILLLCLIFLLVLLDYQGMLPVCPLIPGSSTTSTG

SEQ ID NO: 474 - protein, 35 aa, Artificial Sequence
  Core polypeptide
ILLLCLIFLLVLLDYQGMLPVCPLIPGSSTTSTGP

SEQ ID NO: 475 - protein, 35 aa, Artificial Sequence
  Core polypeptide
LLLCLIFLLVLLDYQGMLPVCPLIPGSSTTSTGPC

SEQ ID NO: 476 - protein, 35 aa, Artificial Sequence
  Core polypeptide
LLCLIFLLVLLDYQGMLPVCPLIPGSSTTSTGPCR

SEQ ID NO: 477 - protein, 35 aa, Artificial Sequence
  Core polypeptide
LCLIFLLVLLDYQGMLPVCPLIPGSSTTSTGPCRT

SEQ ID NO: 478 - protein, 35 aa, Artificial Sequence
  Core polypeptide
CLIFLLVLLDYQGMLPVCPLIPGSSTTSTGPCRTC

SEQ ID NO: 479 - protein, 35 aa, Artificial Sequence
  Core polypeptide
LIFLLVLLDYQGMLPVCPLIPGSSTTSTGPCRTCM

SEQ ID NO: 480 - protein, 35 aa, Artificial Sequence
  Core polypeptide
IFLLVLLDYQGMLPVCPLIPGSSTTSTGPCRTCMT

SEQ ID NO: 481 - protein, 35 aa, Artificial Sequence
  Core polypeptide
FLLVLLDYQGMLPVCPLIPGSSTTSTGPCRTCMTT

SEQ ID NO: 482 - protein, 35 aa, Artificial Sequence
  Core polypeptide
PLLVLQAGFFLLTRILTIPQSLDSWWTSLNFLGGT

SEQ ID NO: 483 - protein, 35 aa, Artificial Sequence
  Core polypeptide
LLVLQAGFFLLTRILTIPQSLDSWWTSLNFLGGTT

SEQ ID NO: 484 - protein, 35 aa, Artificial Sequence
  Core polypeptide
LVLQAGFFLLTRILTIPQSLDSWWTSLNFLGGTTV

SEQ ID NO: 485 - protein, 35 aa, Artificial Sequence
  Core polypeptide
VLQAGFFLLTRILTIPQSLDSWWTSLNFLGGTTVC

SEQ ID NO: 486 - protein, 35 aa, Artificial Sequence
  Core polypeptide
LQAGFFLLTRILTIPQSLDSWWTSLNFLGGTTVCL

SEQ ID NO: 487 - protein, 35 aa, Artificial Sequence
  Core polypeptide
QAGFFLLTRILTIPQSLDSWWTSLNFLGGTTVCLG

SEQ ID NO: 488 - protein, 35 aa, Artificial Sequence
  Core polypeptide
AGFFLLTRILTIPQSLDSWWTSLNFLGGTTVCLGQ

SEQ ID NO: 489 - protein, 35 aa, Artificial Sequence
  Core polypeptide
GFFLLTRILTIPQSLDSWWTSLNFLGGTTVCLGQN

SEQ ID NO: 490 - protein, 35 aa, Artificial Sequence
  Core polypeptide
FFLLTRILTIPQSLDSWWTSLNFLGGTTVCLGQNS

SEQ ID NO: 491 - protein, 35 aa, Artificial Sequence
  Core polypeptide
FLLTRILTIPQSLDSWWTSLNFLGGTTVCLGQNSQ

SEQ ID NO: 492 - protein, 35 aa, Artificial Sequence
  Core polypeptide
LLTRILTIPQSLDSWWTSLNFLGGTTVCLGQNSQS

SEQ ID NO: 493 - protein, 35 aa, Artificial Sequence
  Core polypeptide
LTRILTIPQSLDSWWTSLNFLGGTTVCLGQNSQSP

SEQ ID NO: 494 - protein, 28 aa, Artificial Sequence
  Core polypeptide
FWNWLSAWKDLELKSLLEEVKDELQKMR

SEQ ID NO: 495 - protein, 19 aa, Artificial Sequence
  Core polypeptide
NNLLRAIEAQQHLLQLTVW

SEQ ID NO: 496 - protein, 41 aa, Artificial Sequence
  Core polypeptide
CGGNNLLRAIEAQQHLLQLTVWGIKQLQARILAVERYLKDQ

SEQ ID NO: 497 - protein, 36 aa, Artificial Sequence; identical to SEQ ID NO: 15
  Core polypeptide

SEQ ID NO: 498 - protein, 36 aa, Artificial Sequence; identical to SEQ ID NO: 15
  Core polypeptide

SEQ ID NO: 499 - protein, 35 aa, Artificial Sequence
  Core polypeptide
AVSKGYLSALRTGWYTSVITIELSNIKENKNGTDA

SEQ ID NO: 500 - protein, 36 aa, Artificial Sequence
  Core polypeptide
SISNIETVIEFQQKNNRLLEITREFSVNAGVTTPVS

SEQ ID NO: 501 - protein, 35 aa, Artificial Sequence
  Core polypeptide
DQQIKQYKRLLDRLIIPLYDGLRQKDVIVSNQESN

SEQ ID NO: 502 - protein, 36 aa, Artificial Sequence
  Core polypeptide
YSELTNIFGDNIGSLQEKGIKLQGIASLYRTNITEI

SEQ ID NO: 503 - protein, 36 aa, Artificial Sequence
  Core polypeptide
TSITLQVRLPLLTRLLNTQIYRVDSISYNIQNREWY

SEQ ID NO: 504 - protein, 35 aa, Artificial Sequence
  Core polypeptide
VEIAEYRRLLRTVLEPIRDALNAMTQNIRPVQSVA

SEQ ID NO: 505 - protein, 36 aa, Artificial Sequence
  Core polypeptide
SYFIVLSIAYPTLSEIKGVIVHRLEGVSYNIGSQEW

SEQ ID NO: 506 - protein, 28 aa, Artificial Sequence
  Core polypeptide
LKEAIRDTNKAVQSVQSSIGNLIVAIKS

SEQ ID NO: 507 - protein, 38 aa, Artificial Sequence; identical to SEQ ID NO: 16
  Core polypeptide

SEQ ID NO: 508 - protein, 16 aa, Artificial Sequence
  Core polypeptide
QKQEPIDKELYPLTSL

SEQ ID NO: 509 - protein, 14 aa, Artificial Sequence
  Core polypeptide
YPKFVKQNTLKLAT

SEQ ID NO: 510 - protein, 14 aa, Artificial Sequence
  Core polypeptide
QYIKANQKFIGITE

SEQ ID NO: 511 - protein, 14 aa, Artificial Sequence
  Core polypeptide
NGQIGNDPNRDILY

SEQ ID NO: 512 - protein, 6 aa, Artificial Sequence
  Core polypeptide
RPDVYH

SEQ ID NO: 513 - protein, 15 aa, Artificial Sequence
  Core polypeptide
CLELDKWASLWNWFC

SEQ ID NO: 514 - protein, 15 aa, Artificial Sequence
  Core polypeptide
CLELDKWASLANWFC

SEQ ID NO: 515 - protein, 15 aa, Artificial Sequence
  Core polypeptide
CLELDKWASLANFFC

SEQ ID NO: 516 - protein, 39 aa, Artificial Sequence
  Core polypeptide
NNLLRAIEAQQQHLLQLTVWGIKQLQARILAVERYLKDQ

SEQ ID NO: 517 - protein, 39 aa, Artificial Sequence
  Core polypeptide
CGGYTSLIHSLIEESQNQQEKNEQELLELDKWASLWNWF

SEQ ID NO: 518 - protein, 35 aa, Artificial Sequence; identical to SEQ ID NO: 482
  Core polypeptide

SEQ ID NO: 519 - protein, 35 aa, Artificial Sequence; identical to SEQ ID NO: 483
  Core polypeptide

SEQ ID NO: 520 - protein, 35 aa, Artificial Sequence; identical to SEQ ID NO: 484
  Core polypeptide

SEQ ID NO: 521 - protein, 35 aa, Artificial Sequence; identical to SEQ ID NO: 485
  Core polypeptide

SEQ ID NO: 522 - protein, 35 aa, Artificial Sequence; identical to SEQ ID NO: 486
  Core polypeptide

SEQ ID NO: 523 - protein, 35 aa, Artificial Sequence; identical to SEQ ID NO: 487
  Core polypeptide

SEQ ID NO: 524 - protein, 35 aa, Artificial Sequence; identical to SEQ ID NO: 488
  Core polypeptide

SEQ ID NO: 525 - protein, 35 aa, Artificial Sequence; identical to SEQ ID NO: 489
  Core polypeptide

SEQ ID NO: 526 - protein, 35 aa, Artificial Sequence; identical to SEQ ID NO: 490
  Core polypeptide

SEQ ID NO: 527 - protein, 35 aa, Artificial Sequence; identical to SEQ ID NO: 491
  Core polypeptide

SEQ ID NO: 528 - protein, 35 aa, Artificial Sequence; identical to SEQ ID NO: 492
  Core polypeptide

SEQ ID NO: 529 - protein, 35 aa, Artificial Sequence; identical to SEQ ID NO: 493
  Core polypeptide

SEQ ID NO: 530 - protein, 13 aa, Artificial Sequence
  Core polypeptide
LELDKWASLWNWA

SEQ ID NO: 531 - protein, 13 aa, Artificial Sequence
  Core polypeptide
LELDKWASAWNWF

SEQ ID NO: 532 - protein, 13 aa, Artificial Sequence
  Core polypeptide
LELDKAASLWNWF

SEQ ID NO: 533 - protein, 13 aa, Artificial Sequence
  Core polypeptide
LKLDKWASLWNWF

SEQ ID NO: 534 - protein, 13 aa, Artificial Sequence
  Core polypeptide
LELKKWASLWNWF

SEQ ID NO: 535 - protein, 13 aa, Artificial Sequence
  Core polypeptide
DELLHNVNAGKST

SEQ ID NO: 536 - protein, 15 aa, Artificial Sequence
  Core polypeptide
KSDELLHNVNAGKST

SEQ ID NO: 537 - protein, 17 aa, Artificial Sequence
  Core polypeptide
IRKSDELLHNVNAGKST

SEQ ID NO: 538 - protein, 19 aa, Artificial Sequence
  Core polypeptide
AFIRKSDELLHNVNAGKST

SEQ ID NO: 539 - protein, 19 aa, Artificial Sequence
  Core polypeptide
FDASISQVNEKINQSLAFI

SEQ ID NO: 540 - protein, 36 aa, Artificial Sequence
  Core polypeptide
YAADKESTQKAFDGITNKVNSVIEKMNTQFEAVGKE

SEQ ID NO: 541 - protein, 36 aa, Artificial Sequence
  Core polypeptide
SVIEKMNTQFEAVGKEFGNLERRLENLNKRMEDGFL

SEQ ID NO: 542 - protein, 36 aa, Artificial Sequence
  Core polypeptide
VWTYNAELLVLMENERTLDFHDSNVKNLYDKVRMQL

SEQ ID NO: 543 - protein, 33 aa, Artificial Sequence
  Core polypeptide
EWDREINNYTSLIHSLIEESQNQQEKNEQEGGC

SEQ ID NO: 544 - protein, 35 aa, Artificial Sequence
  Core polypeptide
INNYTSLIHSLIEESQNQQEKNEQELLELDKWASL

SEQ ID NO: 545 - protein, 28 aa, Artificial Sequence
  Core polypeptide
INNYTSLIHSLIEESQNQQEKNEQELLE

SEQ ID NO: 546 - protein, 35 aa, Artificial Sequence
  Core polypeptide
WMEWDREINNYTSLIHSLIEESQNQQEKNEQELLE

SEQ ID NO: 547 - protein, 48 aa, Artificial Sequence
  Core polypeptide
MTWMEWDREINNYTSLIHSLIEESQNQQEKNEQELLELDKWASLWNWF

SEQ ID NO: 548 - protein, 35 aa, Artificial Sequence
  Core polypeptide
IDISIELNKAKSDLEESKEWIKKSNQKLDSIGNWH

SEQ ID NO: 549 - protein, 36 aa, Artificial Sequence
  Core polypeptide
NQQEKNEQELLELDKWASLWNWFNITNWLWYIKIFI

SEQ ID NO: 550 - protein, 36 aa, Artificial Sequence
  Core polypeptide
QNQQEKNEQELLELDKWASLWNWFNITNWLWYIKIF

SEQ ID NO: 551 - protein, 36 aa, Artificial Sequence
  Core polypeptide
SQNQQEKNEQELLELDKWASLWNWFNITNWLWYIKI

SEQ ID NO: 552 - protein, 36 aa, Artificial Sequence
  Core polypeptide
ESQNQQEKNEQELLELDKWASLWNWFNITNWLWYIK

SEQ ID NO: 553 - protein, 36 aa, Artificial Sequence
  Core polypeptide
EESQNQQEKNEQELLELDKWASLWNWFNITNWLWYI

SEQ ID NO: 554 - protein, 36 aa, Artificial Sequence
  Core polypeptide
IEESQNQQEKNEQELLELDKWASLWNWFNITNWLWY

SEQ ID NO: 555 - protein, 36 aa, Artificial Sequence
  Core polypeptide
LIEESQNQQEKNEQELLELDKWASLWNWFNITNWLW

SEQ ID NO: 556 - protein, 36 aa, Artificial Sequence
  Core polypeptide
SLIEESQNQQEKNEQELLELDKWASLWNWFNITNWL

SEQ ID NO: 557 - protein, 36 aa, Artificial Sequence
  Core polypeptide
HSLIEESQNQQEKNEQELLELDKWASLWNWFNITNW

SEQ ID NO: 558 - protein, 36 aa, Artificial Sequence
  Core polypeptide
IHSLIEESQNQQEKNEQELLELDKWASLWNWFNITN

SEQ ID NO: 559 - protein, 36 aa, Artificial Sequence
  Core polypeptide
LIHSLIEESQNQQEKNEQELLELDKWASLWNWFNIT

SEQ ID NO: 560 - protein, 36 aa, Artificial Sequence
  Core polypeptide
SLIHSLIEESQNQQEKNEQELLELDKWASLWNWFNI

SEQ ID NO: 561 - protein, 36 aa, Artificial Sequence
  Core polypeptide
TSLIHSLIEESQNQQEKNEQELLELDKWASLWNWFN

SEQ ID NO: 562 - protein, 36 aa, Artificial Sequence
  Core polypeptide
NYTSLIHSLIEESQNQQEKNEQELLELDKWASLWNW

SEQ ID NO: 563 - protein, 36 aa, Artificial Sequence
  Core polypeptide
NNYTSLIHSLIEESQNQQEKNEQELLELDKWASLWN

SEQ ID NO: 564 - protein, 36 aa, Artificial Sequence
  Core polypeptide
INNYTSLIHSLIEESQNQQEKNEQELLELDKWASLW

SEQ ID NO: 565 - protein, 36 aa, Artificial Sequence
  Core polypeptide
EINNYTSLIHSLIEESQNQQEKNEQELLELDKWASL

SEQ ID NO: 566 - protein, 36 aa, Artificial Sequence
  Core polypeptide
REINNYTSLIHSLIEESQNQQEKNEQELLELDKWAS

SEQ ID NO: 567 - protein, 36 aa, Artificial Sequence
  Core polypeptide
DREINNYTSLIHSLIEESQNQQEKNEQELLELDKWA

SEQ ID NO: 568 - protein, 36 aa, Artificial Sequence
  Core polypeptide
WDREINNYTSLIHSLIEESQNQQEKNEQELLELDKW

SEQ ID NO: 569 - protein, 36 aa, Artificial Sequence
  Core polypeptide
EWDREINNYTSLIHSLIEESQNQQEKNEQELLELDK

SEQ ID NO: 570 - protein, 38 aa, Artificial Sequence
  Core polypeptide
MEWDREINNYTSLIHSLIEESQNQQEKNEQELLELDNH

SEQ ID NO: 571 - protein, 36 aa, Artificial Sequence
  Core polypeptide
MEWDREINNYTSLIHSLIEESQNQQEKNEQELLELD

SEQ ID NO: 572 - protein, 36 aa, Artificial Sequence
  Core polypeptide
WMEWDREINNYTSLIHSLIEESQNQQEKNEQELLEL

SEQ ID NO: 573 - protein, 36 aa, Artificial Sequence
  Core polypeptide
TWMEWDREINNYTSLIHSLIEESQNQQEKNEQELLE

SEQ ID NO: 574 - protein, 36 aa, Artificial Sequence
  Core polypeptide
MTWMEWDREINNYTSLIHSLIEESQNQQEKNEQELL

SEQ ID NO: 575 - protein, 36 aa, Artificial Sequence
  Core polypeptide
NMTWMEWDREINNYTSLIHSLIEESQNQQEKNEQEL

SEQ ID NO: 576 - protein, 36 aa, Artificial Sequence
  Core polypeptide
NNMTWMEWDREINNYTSLIHSLIEESQNQQEKNEQE

SEQ ID NO: 577 - protein, 36 aa, Artificial Sequence
  Core polypeptide
WNNMTWMEWDREINNYTSLIHSLIEESQNQQEKNEQ

SEQ ID NO: 578 - protein, 36 aa, Artificial Sequence
  Core polypeptide
IWNNMTWMEWDREINNYTSLIHSLIEESQNQQEKNE

SEQ ID NO: 579 - protein, 36 aa, Artificial Sequence
  Core polypeptide
QIWNNMTWMEWDREINNYTSLIHSLIEESQNQQEKN

SEQ ID NO: 580 - protein, 36 aa, Artificial Sequence
  Core polypeptide
EQIWNNMTWMEWDREINNYTSLIHSLIEESQNQQEK

SEQ ID NO: 581 - protein, 36 aa, Artificial Sequence
  Core polypeptide
LEQIWNNMTWMEWDREINNYTSLIHSLIEESQNQQE

SEQ ID NO: 582 - protein, 36 aa, Artificial Sequence
  Core polypeptide
SLEQIWNNMTWMEWDREINNYTSLIHSLIEESQNQQ

SEQ ID NO: 583 - protein, 36 aa, Artificial Sequence
  Core polypeptide
KSLEQIWNNMTWMEWDREINNYTSLIHSLIEESQNQ

SEQ ID NO: 584 - protein, 36 aa, Artificial Sequence
  Core polypeptide
NKSLEQIWNNMTWMEWDREINNYTSLIHSLIEESQN

SEQ ID NO: 585 - protein, 21 aa, Artificial Sequence
  Core polypeptide
SLAFIRKSDELLHNVNAGKST

SEQ ID NO: 586 - protein, 21 aa, Artificial Sequence
  Core polypeptide
FDASISQVNEKINQSLAFIRK

SEQ ID NO: 587 - protein, 36 aa, Artificial Sequence
  Core polypeptide
YTSLIHSLIEESQQQQEKQEQELLELDKWASLWNWF

SEQ ID NO: 588 - protein, 33 aa, Artificial Sequence
  Core polypeptide
FDASISQVNEKINQSLAFIRKSDELLHNVNAGK

SEQ ID NO: 589 - protein, 31 aa, Artificial Sequence
  Core polypeptide
FDASISQVNEKINQSLAFIRKSDELLHNVNA

SEQ ID NO: 590 - protein, 29 aa, Artificial Sequence
  Core polypeptide
FDASISQVNEKINQSLAFIRKSDELLHNV

SEQ ID NO: 591 - protein, 27 aa, Artificial Sequence
  Core polypeptide
FDASISQVNEKINQSLAFIRKSDELLH

SEQ ID NO: 592 - protein, 25 aa, Artificial Sequence
  Core polypeptide
FDASISQVNEKINQSLAFIRKSDEL

SEQ ID NO: 593 - protein, 23 aa, Artificial Sequence
  Core polypeptide
FDASISQVNEKINQSLAFIRKSD

SEQ ID NO: 594 - protein, 33 aa, Artificial Sequence
  Core polypeptide
ASISQVNEKINQSLAFIRKSDELLHNVNAGKST

SEQ ID NO: 595 - protein, 31 aa, Artificial Sequence
  Core polypeptide
ISQVNEKINQSLAFIRKSDELLHNVNAGKST

SEQ ID NO: 596 - protein, 29 aa, Artificial Sequence
  Core polypeptide
QVNEKINQSLAFIRKSDELLHNVNAGKST

SEQ ID NO: 597 - protein, 27 aa, Artificial Sequence
  Core polypeptide
NEKINQSLAFIRKSDELLHNVNAGKST

SEQ ID NO: 598 - protein, 25 aa, Artificial Sequence
  Core polypeptide
KINQSLAFIRKSDELLHNVNAGKST

SEQ ID NO: 599 - protein, 23 aa, Artificial Sequence
  Core polypeptide
NQSLAFIRKSDELLHNVNAGKST

SEQ ID NO: 600 - protein, 30 aa, Artificial Sequence
  Core polypeptide
FWNWLSAWKDLELYPGSLELDKWASLWNWF

SEQ ID NO: 601 - protein, 41 aa, Artificial Sequence; identical to SEQ ID NO: 496
  Core polypeptide

SEQ ID NO: 602 - protein, 39 aa, Artificial Sequence; identical to SEQ ID NO: 517
  Core polypeptide

SEQ ID NO: 603 - protein, 36 aa, Artificial Sequence; identical to SEQ ID NO: 15
  Core polypeptide

SEQ ID NO: 604 - protein, 38 aa, Artificial Sequence; identical to SEQ ID NO: 16
  Core polypeptide

SEQ ID NO: 605 - protein, 36 aa, Artificial Sequence
  Core polypeptide
EKNMYELQKLNSWDVFTNWLDFTSWVRYIQYIQYGV

SEQ ID NO: 606 - protein, 36 aa, Artificial Sequence
  Core polypeptide
QEKNMYELQKLNSWDVFTNWLDFTSWVRYIQYIQYG

SEQ ID NO: 607 - protein, 36 aa, Artificial Sequence
  Core polypeptide
QQEKNMYELQKLNSWDVFTNWLDFTSWVRYIQYIQY

SEQ ID NO: 608 - protein, 36 aa, Artificial Sequence
  Core polypeptide
IQQEKNMYELQKLNSWDVFTNWLDFTSWVRYIQYIQ

SEQ ID NO: 609 - protein, 36 aa, Artificial Sequence
  Core polypeptide
QIQQEKNMYELQKLNSWDVFTNWLDFTSWVRYIQYI

SEQ ID NO: 610 - protein, 36 aa, Artificial Sequence
  Core polypeptide
AQIQQEKNMYELQKLNSWDVFTNWLDFTSWVRYIQY

SEQ ID NO: 611 - protein, 36 aa, Artificial Sequence
  Core polypeptide
QAQIQQEKNMYELQKLNSWDVFTNWLDFTSWVRYIQ

SEQ ID NO: 612 - protein, 36 aa, Artificial Sequence
  Core polypeptide
EQAQIQQEKNMYELQKLNSWDVFTNWLDFTSWVRYI

SEQ ID NO: 613 - protein, 36 aa, Artificial Sequence
  Core polypeptide
LEQAQIQQEKNMYELQKLNSWDVFTNWLDFTSWVRY

SEQ ID NO: 614 - protein, 36 aa, Artificial Sequence
  Core polypeptide
SLEQAQIQQEKNMYELQKLNSWDVFTNWLDFTSWVR

SEQ ID NO: 615 - protein, 36 aa, Artificial Sequence
  Core polypeptide
QSLEQAQIQQEKNMYELQKLNSWDVFTNWLDFTSWV

SEQ ID NO: 616 - protein, 36 aa, Artificial Sequence
  Core polypeptide
SQSLEQAQIQQEKNMYELQKLNSWDVFTNWLDFTSW

SEQ ID NO: 617 - protein, 36 aa, Artificial Sequence
  Core polypeptide
ISQSLEQAQIQQEKNMYELQKLNSWDVFTNWLDFTS

SEQ ID NO: 618 - protein, 36 aa, Artificial Sequence
  Core polypeptide
NISQSLEQAQIQQEKNMYELQKLNSWDVFTNWLDFT

SEQ ID NO: 619 - protein, 36 aa, Artificial Sequence
  Core polypeptide
ANISQSLEQAQIQQEKNMYELQKLNSWDVFTNWLDF

SEQ ID NO: 620 - protein, 36 aa, Artificial Sequence
  Core polypeptide
EANISQSLEQAQIQQEKNMYELQKLNSWDVFTNWLD

SEQ ID NO: 621 - protein, 36 aa, Artificial Sequence
  Core polypeptide
LEANISQSLEQAQIQQEKNMYELQKLNSWDVFTNWL

SEQ ID NO: 622 - protein, 36 aa, Artificial Sequence
  Core polypeptide
YLEANISQSLEQAQIQQEKNMYELQKLNSWDVFTNW

SEQ ID NO: 623 - protein, 23 aa, Artificial Sequence
  Core polypeptide
YTSLIHSLIEESQNQQEKNEQEL

SEQ ID NO: 624 - protein, 36 aa, Artificial Sequence
  Core polypeptide
YTSLIHSLIEESQNLQEKNEQELLELDKWASLWNWF

SEQ ID NO: 625 - protein, 36 aa, Artificial Sequence
  Core polypeptide
YTSLIHSLIEESQNQQEKLEQELLELDKWASLWNWF

SEQ ID NO: 626 - protein, 36 aa, Artificial Sequence
  Core polypeptide
YTSLIHSLIEESQNQQEKNEQELLEFDKWASLWNWF

SEQ ID NO: 627 - protein, 36 aa, Artificial Sequence
  Core polypeptide
YTSLIHSLIEESQNQQEKNEQELLELDKPASLWNWF

SEQ ID NO: 628 - protein, 36 aa, Artificial Sequence
  Core polypeptide
YTSLIHSLIEESQNQQEKNEQELLELDKWASPWNWF

SEQ ID NO: 629 - protein, 36 aa, Artificial Sequence
  Core polypeptide
YTSLIHSLIEESQNQQEKNEQELLELDKWASLWNSF

SEQ ID NO: 630 - protein, 36 aa, Artificial Sequence; identical to SEQ ID NO: 15
  Core polypeptide

SEQ ID NO: 631 - protein, 36 aa, Artificial Sequence; identical to SEQ ID NO: 15
  Core polypeptide

SEQ ID NO: 632 - protein, 39 aa, Artificial Sequence
  Core polypeptide
FMCYTSLIHSLIEESQNQQEKNEQELLELDKWASLWNWF

SEQ ID NO: 633 - protein, 41 aa, Artificial Sequence
  Core polypeptide
FMCNNLLRAIEAQQHLLQLTVWGIKQLQARILAVERYLKDQ

SEQ ID NO: 634 - protein, 30 aa, Artificial Sequence
  Core polypeptide
EWDREINNYTSLIHSLIEESQNQQEKNEQE

SEQ ID NO: 635 - protein, 29 aa, Artificial Sequence
  Core polypeptide
LIEESQNQQEKNEQELLELDKWASLWNWF

SEQ ID NO: 636 - protein, 35 aa, Artificial Sequence
  Core polypeptide
FWNWLSAWKDLELGGPGSGPGGLELDKWASLWNWF

SEQ ID NO: 637 - protein, 29 aa, Artificial Sequence
  Core polypeptide
LIHSLIEESQNQQEKNEQELLELDKWASL

SEQ ID NO: 638 - protein, 35 aa, Artificial Sequence
  Core polypeptide
TSLIHSLIEESQNQQEKNEQELLELDKWASLWNWF

SEQ ID NO: 639 - protein, 33 aa, Artificial Sequence; identical to SEQ ID NO: 61
  Core polypeptide

SEQ ID NO: 640 - protein, 41 aa, Artificial Sequence
  Core polypeptide
GGGGGYTSLIHSLIEESQNQQEKNEQELLELDKWASLWNWF

SEQ ID NO: 641 - protein, 31 aa, Artificial Sequence
  Core polypeptide
HSLIEESQNQQEKNEQELLELDKWASLWNWF

SEQ ID NO: 642 - protein, 36 aa, Artificial Sequence
  Core polypeptide
YTSLIYSLIEESQNQQEKNEQELLELDKWASLWNWF

SEQ ID NO: 643 - protein, 36 aa, Artificial Sequence
  Core polypeptide
YTSLIHSLIEKSQNQQEKNEQELLELDKWASLWNWF

SEQ ID NO: 644 - protein, 36 aa, Artificial Sequence
  Core polypeptide
YTSLIHSSIEESQNQQEKNEQELLELDKWASLWNWF

SEQ ID NO: 645 - protein, 36 aa, Artificial Sequence
  Core polypeptide
LEANISQLLEQAQIQQEKNMYELQKLNSWDVFTNWL

SEQ ID NO: 646 - protein, 35 aa, Artificial Sequence
  Core polypeptide
SLEECDSELEIKRYKNRVASRKCRAKFKQLLQHYR

SEQ ID NO: 647 - protein, 35 aa, Artificial Sequence
  Core polypeptide
LEECDSELEIKRYKNRVASRKCRAKFKQLLQHYRE

SEQ ID NO: 648 - protein, 35 aa, Artificial Sequence
  Core polypeptide
EECDSELEIKRYKNRVASRKCRAKFKQLLQHYREV

SEQ ID NO: 649 - protein, 35 aa, Artificial Sequence
  Core polypeptide
ECDSELEIKRYKNRVASRKCRAKFKQLLQHYREVA

SEQ ID NO: 650 - protein, 35 aa, Artificial Sequence
  Core polypeptide
CDSELEIKRYKNRVASRKCRAKFKQLLQHYREVAA

SEQ ID NO: 651 - protein, 35 aa, Artificial Sequence
  Core polypeptide
DSELEIKRYKNRVASRKCRAKFKQLLQHYREVAAA

SEQ ID NO: 652 - protein, 49 aa, Artificial Sequence
  Core polypeptide
DESAMINTYRSINEFDASISQVNEKINQSLAFIRKSDELLHNVNAGKST

SEQ ID NO: 653 - protein, 7 aa, Artificial Sequence
  Core polypeptide
WASLWNW

SEQ ID NO: 654 - protein, 38 aa, Artificial Sequence
  Core polypeptide
EAQQHLLQLTVWGIKQLQARILAVERYLKDQQLLGIWG

SEQ ID NO: 655 - protein, 38 aa, Artificial Sequence
  Core polypeptide
IEAQQHLLQLTVWGIKQLQARILAVERYLKDQQLLGIW

SEQ ID NO: 656 - protein, 38 aa, Artificial Sequence
  Core polypeptide
AIEAQQHLLQLTVWGIKQLQARILAVERYLKDQQLLGI

SEQ ID NO: 657 - protein, 38 aa, Artificial Sequence
  Core polypeptide
RAIEAQQHLLQLTVWGIKQLQARILAVERYLKDQQLLG

SEQ ID NO: 658 - protein, 38 aa, Artificial Sequence
  Core polypeptide
LRAIEAQQHLLQLTVWGIKQLQARILAVERYLKDQQLL

SEQ ID NO: 659 - protein, 38 aa, Artificial Sequence
  Core polypeptide
LLRAIEAQQHLLQLTVWGIKQLQARILAVERYLKDQQL

SEQ ID NO: 660 - protein, 38 aa, Artificial Sequence
  Core polypeptide
NLLRAIEAQQHLLQLTVWGIKQLQARILAVERYLKDQQ

SEQ ID NO: 661 - protein, 38 aa, Artificial Sequence
  Core polypeptide
QNNLLRAIEAQQHLLQLTVWGIKQLQARILAVERYLKD

SEQ ID NO: 662 - protein, 38 aa, Artificial Sequence
  Core polypeptide
QQNNLLRAIEAQQHLLQLTVWGIKQLQARILAVERYLK

SEQ ID NO: 663 - protein, 38 aa, Artificial Sequence
  Core polypeptide
QQQNNLLRAIEAQQHLLQLTVWGIKQLQARILAVERYL

SEQ ID NO: 664 - protein, 38 aa, Artificial Sequence
  Core polypeptide
VQQQNNLLRAIEAQQHLLQLTVWGIKQLQARILAVERY

SEQ ID NO: 665 - protein, 38 aa, Artificial Sequence
  Core polypeptide
IVQQQNNLLRAIEAQQHLLQLTVWGIKQLQARILAVER

SEQ ID NO: 666 - protein, 38 aa, Artificial Sequence
  Core polypeptide
GIVQQQNNLLRAIEAQQHLLQLTVWGIKQLQARILAVE

SEQ ID NO: 667 - protein, 38 aa, Artificial Sequence
  Core polypeptide
SGIVQQQNNLLRAIEAQQHLLQLTVWGIKQLQARILAV

SEQ ID NO: 668 - protein, 38 aa, Artificial Sequence
  Core polypeptide
RSMTLTVQARQLLSGIVQQQNNLLRAIEAQQHLLQLTV

SEQ ID NO: 669 - protein, 38 aa, Artificial Sequence
  Core polypeptide
GARSMTLTVQARQLLSGIVQQQNNLLRAIEAQQHLLQL

SEQ ID NO: 670 - protein, 38 aa, Artificial Sequence
  Core polypeptide
GSTMGARSMTLTVQARQLLSGIVQQQNNLLRAIEAQQH

SEQ ID NO: 671 - protein, 38 aa, Artificial Sequence; identical to SEQ ID NO: 670
  Core polypeptide

SEQ ID NO: 672 - protein, 38 aa, Artificial Sequence
  Core polypeptide
EGSTMGARSMTLTVQARQLLSGIVQQQNNLLRAIEAQQ

SEQ ID NO: 673 - protein, 28 aa, Artificial Sequence
  Core polypeptide
RAKFKQLLQHYREVAAAKSSENDRLRLL

SEQ ID NO: 674 - protein, 28 aa, Artificial Sequence
  Core polypeptide
AKFKQLLQHYREVAAAKSSENDRLRLLL

SEQ ID NO: 675 - protein, 28 aa, Artificial Sequence
  Core polypeptide
KFKQLLQHYREVAAAKSSENDRLRLLLK

SEQ ID NO: 676 - protein, 28 aa, Artificial Sequence
  Core polypeptide
FKQLLQHYREVAAAKSSENDRLRLLLKQ

SEQ ID NO: 677 - protein, 35 aa, Artificial Sequence
  Core polypeptide
RAKFKQELQHYREVAAAKSSENDRLRLLLKQMCPS

SEQ ID NO: 678 - protein, 10 aa, Artificial Sequence
  Core polypeptide
DKWASLWNWF

SEQ ID NO: 679 - protein, 35 aa, Artificial Sequence; identical to SEQ ID NO: 114
  Core polypeptide

SEQ ID NO: 680 - protein, 35 aa, Artificial Sequence
  Core polypeptide
YDASISQVNEKINQSLAFIRKSDELLHNVNAGKST

SEQ ID NO: 681 - protein, 35 aa, Artificial Sequence
  Core polypeptide
YDASISQVNEKINQSLAYIRKSDELLHNVNAGKST

SEQ ID NO: 682 - protein, 35 aa, Artificial Sequence
  Core polypeptide
FDASISQVNEKINQSLAYIRKSDELLHNVNAGKST

SEQ ID NO: 683 - protein, 35 aa, Artificial Sequence
  Core polypeptide
FDASISQVQEKIQQSLAFIRKSDELLHQVQAGKST

SEQ ID NO: 684 - protein, 35 aa, Artificial Sequence
  Core polypeptide
FDASISQVNEKINQALAFIRKADELLHNVNAGKST

SEQ ID NO: 685 - protein, 35 aa, Artificial Sequence
  Core polypeptide
FDASISQVNEKINQALAFIRKSDELLHNVNAGKST

SEQ ID NO: 686 - protein, 35 aa, Artificial Sequence
  Core polypeptide
FDASISQVNEKINQSLAFIRKADELLHNVNAGKST

SEQ ID NO: 687 - protein, 35 aa, Artificial Sequence
  Core polypeptide
YDASISQVQEEIQQALAFIRKADELLEQVQAGKST

SEQ ID NO: 688 - protein, 35 aa, Artificial Sequence
  Core polypeptide
FDASISQVNEKINQSLAFIRKSDELLENVNAGKST

SEQ ID NO: 689 - protein, 35 aa, Artificial Sequence
  Core polypeptide
FDASISQVNEEINQSLAFIRKSDELLHNVNAGKST

SEQ ID NO: 690 - protein, 35 aa, Artificial Sequence
  Core polypeptide
VFPSDEFDASISQVNEKINQSLAFIRKSDELLENV

SEQ ID NO: 691 - protein, 35 aa, Artificial Sequence
  Core polypeptide
VFPSDEFDASISQVNEEINQSLAFIRKSDELLENV

SEQ ID NO: 692 - protein, 35 aa, Artificial Sequence
  Core polypeptide
VYPSDEYDASISQVNEEINQALAYIRKADELLENV

SEQ ID NO: 693 - protein, 35 aa, Artificial Sequence
  Core polypeptide
VFPSDEFDASISQVNEEINQSLAFIRKSDELLHNV

SEQ ID NO: 694 - protein, 36 aa, Artificial Sequence
  Core polypeptide
SNKSLEQIWNNMTWMEWDREINNYTSLIHSLIEESQ

SEQ ID NO: 695 - protein, 36 aa, Artificial Sequence
  Core polypeptide
WSNKSLEQIWNNMTWMEWDREINNYTSLIHSLIEES

SEQ ID NO: 696 - protein, 36 aa, Artificial Sequence
  Core polypeptide
SWSNKSLEQIWNNMTWMEWDREINNYTSLIHSLIEE

SEQ ID NO: 697 - protein, 36 aa, Artificial Sequence
  Core polypeptide
ASWSNKSLEQIWNNMTWMEWDREINNYTSLIHSLIE

SEQ ID NO: 698 - protein, 36 aa, Artificial Sequence
  Core polypeptide
NASWSNKSLEQIWNNMTWMEWDREINNYTSLIHSLI

SEQ ID NO: 699 - protein, 36 aa, Artificial Sequence
  Core polypeptide
WNASWSNKSLEQIWNNMTWMEWDREINNYTSLIHSL

SEQ ID NO: 700 - protein, 36 aa, Artificial Sequence
  Core polypeptide
PWNASWSNKSLEQIWNNMTWMEWDREINNYTSLIHS

SEQ ID NO: 701 - protein, 36 aa, Artificial Sequence
  Core polypeptide
VPWNASWSNKSLEQIWNNMTWMEWDREINNYTSLIH

SEQ ID NO: 702 - protein, 36 aa, Artificial Sequence
  Core polypeptide
AVPWNASWSNKSLEQIWNNMTWMEWDREINNYTSLI

SEQ ID NO: 703 - protein, 36 aa, Artificial Sequence
  Core polypeptide
TAVPWNASWSNKSLEQIWNNMTWMEWDREINNYTSL

SEQ ID NO: 704 - protein, 36 aa, Artificial Sequence
  Core polypeptide
TTAVPWNASWSNKSLEQIWNNMTWMEWDREINNYTS

SEQ ID NO: 705 - protein, 36 aa, Artificial Sequence; identical to SEQ ID NO: 15
  Core polypeptide

SEQ ID NO: 706 - protein, 35 aa, Artificial Sequence
  Core polypeptide
AAASDEFDASISQVNEKINQSLAFIRKSDELLHNV

SEQ ID NO: 707 - protein, 35 aa, Artificial Sequence
  Core polypeptide
VFPAAAFDASISQVNEKINQSLAFIRKSDELLHNV

SEQ ID NO: 708 - protein, 35 aa, Artificial Sequence
  Core polypeptide
VFPSDEAAASISQVNEKINQSLAFIRKSDELLHNV

SEQ ID NO: 709 - protein, 35 aa, Artificial Sequence
  Core polypeptide
VFPSDEFDAAAAQVNEKINQSLAFIRKSDELLHNV

SEQ ID NO: 710 - protein, 35 aa, Artificial Sequence
  Core polypeptide
VFPSDEFDASISAAAEKINQSLAFIRKSDELLHNV

SEQ ID NO: 711 - protein, 35 aa, Artificial Sequence
  Core polypeptide
VFPSDEFDASISQVNAAANQSLAFIRKSDELLHNV

SEQ ID NO: 712 - protein, 35 aa, Artificial Sequence
  Core polypeptide
VFPSDEFDASISQVNEKIAAALAFIRKSDELLHNV

SEQ ID NO: 713 - protein, 35 aa, Artificial Sequence
  Core polypeptide
VFPSDEFDASISQVNEKINQSAAAIRKSDELLHNV

SEQ ID NO: 714 - protein, 35 aa, Artificial Sequence
  Core polypeptide
VFPSDEFDASISQVNEKINQSLAFAAASDELLHNV

SEQ ID NO: 715 - protein, 35 aa, Artificial Sequence
  Core polypeptide
VFPSDEFDASISQVNEKINQSLAFIRKAAALLHNV

SEQ ID NO: 716 - protein, 35 aa, Artificial Sequence
  Core polypeptide
VFPSDEFDASISQVNEKINQSLAFIRKSDEAAANV

SEQ ID NO: 717 - protein, 35 aa, Artificial Sequence
  Core polypeptide
VFPSDEFDASISQVNEKINQSLAFIRKSDELLAAA

SEQ ID NO: 718 - protein, 35 aa, Artificial Sequence
  Core polypeptide
VYPSDEFDASISQVNEKINQSLAFIRKSDELLHNV

SEQ ID NO: 719 - protein, 36 aa, Artificial Sequence
  Core polypeptide
AAAAIHSLIEESQNQQEKNEQELLELDKWASLWNWF

SEQ ID NO: 720 - protein, 36 aa, Artificial Sequence
  Core polypeptide
YTSLIHSLIEESQQQQEKNEQELLELDKWASLWNWF

SEQ ID NO: 721 - protein, 36 aa, Artificial Sequence
  Core polypeptide
YTSLIHSLIEESQNQQEKQEQELLELDKWASLWNWF

SEQ ID NO: 722 - protein, 36 aa, Artificial Sequence
  Core polypeptide
QIWNNMTWMEWDREINNYTSLIHSLIEESQNQQEKQ

SEQ ID NO: 723 - protein, 36 aa, Artificial Sequence
  Core polypeptide
QIWNNMTWMEWDREINNYTSLIHSLIEESQQQQEKN

SEQ ID NO: 724 - protein, 36 aa, Artificial Sequence
  Core polypeptide
QIWNNMTWMEWDREINNYTSLIHSLIEESQQQQEKQ

SEQ ID NO: 725 - protein, 36 aa, Artificial Sequence
  Core polypeptide
NKSLEQIWNNMTWMEWDREINNYTSLIHSLIEESQQ

SEQ ID NO: 726 - protein, 35 aa, Artificial Sequence
  Core polypeptide
FDASISQVNEKINQSLAFIEESDELLHNVNAGKST

SEQ ID NO: 727 - protein, 9 aa, Artificial Sequence
  Core polypeptide
IRKSDELCL

SEQ ID NO: 728 - protein, 36 aa, Artificial Sequence
  Core polypeptide
YTSLIHSLIEESQNQQEKDEQELLELDKWASLWNWF

SEQ ID NO: 729 - protein, 36 aa, Artificial Sequence
  Core polypeptide
YTSLIHSLIEESQDQQEKNEQELLELDKWASLWNWF

SEQ ID NO: 730 - protein, 36 aa, Artificial Sequence
  Core polypeptide
YTSLIHSLIEESQDQQEKDEQELLELDKWASLWNWF

SEQ ID NO: 731 - protein, 36 aa, Artificial Sequence
  Core polypeptide
YTSLIHSLIEESQNQQEKNEQELLELDKWASLWDWF

SEQ ID NO: 732 - protein, 36 aa, Artificial Sequence
  Core polypeptide
LEANITQSLEQAQIQQEKNMYELQKLNSWDVFTNWL

SEQ ID NO: 733 - protein, 36 aa, Artificial Sequence
  Core polypeptide
LEANISASLEQAQIQQEKNMYELQKLNSWDVFTNWL

SEQ ID NO: 734 - protein, 36 aa, Artificial Sequence
  Core polypeptide
LEANISALLEQAQIQQEKNMYELQKLNSWDVFTNWL

SEQ ID NO: 735 - protein, 36 aa, Artificial Sequence
  Core polypeptide
LEANITALLEQAQIQQEKNMYELQKLNSWDVFTNWL

SEQ ID NO: 736 - protein, 36 aa, Artificial Sequence
  Core polypeptide
LEANITASLEQAQIQQEKNMYELQKLNSWDVFTNWL

SEQ ID NO: 737 - protein, 34 aa, Artificial Sequence
  Core polypeptide
RAKFKQLLQHYREVAAAKSSENDRLRLLLKQMPS

SEQ ID NO: 738 - protein, 30 aa, Artificial Sequence
  Core polypeptide
MNSVKNGTYDYPKYEEESKLNRNEIKGVKL

SEQ ID NO: 739 - protein, 36 aa, Artificial Sequence
  Core polypeptide
WQEWEQKVRYLEANISQSLEQAQIQQEKNMYELQKL

SEQ ID NO: 740 - protein, 35 aa, Artificial Sequence
  Core polypeptide
DEYDASISQVNEKINQSLAFIRKSDELLHNVNAGK

SEQ ID NO: 741 - protein, 34 aa, Artificial Sequence
  Core polypeptide
YTSLIHSLIEESQNQQEKNEQELLELDKWASLWN

SEQ ID NO: 742 - protein, 33 aa, Artificial Sequence
  Core polypeptide
YTSLIHSLIEESQNQQEKNEQELLELDKWASLW

SEQ ID NO: 743 - protein, 32 aa, Artificial Sequence
  Core polypeptide
YTSLIHSLIEESQNQQEKNEQELLELDKWASL

SEQ ID NO: 744 - protein, 31 aa, Artificial Sequence
  Core polypeptide
YTSLIHSLIEESQNQQEKNEQELLELDKWAS

SEQ ID NO: 745 - protein, 51 aa, Artificial Sequence
  Core polypeptide
QARQLLSGIVQQQNNLLRAIEAQQHLLQLTVWGIKQLQARILAVERYLKDQ

SEQ ID NO: 746 - protein, 42 aa, Artificial Sequence
  Core polypeptide
DREINNYTSLIHSLIEESQNQQEKNEQELLELDKWASLWNWF

SEQ ID NO: 747 - protein, 42 aa, Artificial Sequence
  Core polypeptide
NNMTWMEWDREINNYTSLIHSLIEESQNQQEKNEQELLELDK

SEQ ID NO: 748 - protein, 36 aa, Artificial Sequence
  Core polypeptide
YTSLIHSLIEESQNQQEKNEQELLELDKWASLWAAA

SEQ ID NO: 749 - protein, 36 aa, Artificial Sequence
  Core polypeptide
YTSLIHSLIEESQNQQEKNEQELLELDKWAAAANWF

SEQ ID NO: 750 - protein, 36 aa, Artificial Sequence
  Core polypeptide
YTSLIHSLIEESQNQQEKNEQELLELDAAASLWNWF

SEQ ID NO: 751 - protein, 36 aa, Artificial Sequence
  Core polypeptide
YTSLIHSLIEESQNQQEKNEQELLAAAKWASLWNWF

SEQ ID NO: 752 - protein, 36 aa, Artificial Sequence
  Core polypeptide
YTSLIHSLIEESQNQQEKNEQAAAELDKWASLWNWF

SEQ ID NO: 753 - protein, 36 aa, Artificial Sequence
  Core polypeptide
YTSLIHSLIEESQNQQEKAAAELLELDKWASLWNWF

SEQ ID NO: 754 - protein, 36 aa, Artificial Sequence
  Core polypeptide
YTSLIHSLIEESQNQAAANEQELLELDKWASLWNWF

SEQ ID NO: 755 - protein, 36 aa, Artificial Sequence
  Core polypeptide
YTSLIHSLIEESAAAQEKNEQELLELDKWASLWNWF

SEQ ID NO: 756 - protein, 36 aa, Artificial Sequence
  Core polypeptide
YTSLIHSLIAAAQNQQEKNEQELLELDKWASLWNWF

SEQ ID NO: 757 - protein, 36 aa, Artificial Sequence
  Core polypeptide
YTSLIHAAAEESQNQQEKNEQELLELDKWASLWNWF

SEQ ID NO: 758 - protein, 36 aa, Artificial Sequence
  Core polypeptide
YTSAAASLIEESQNQQEKNEQELLELDKWASLWNWF

SEQ ID NO: 759 - protein, 35 aa, Artificial Sequence
  Core polypeptide
EIWNNMTWMEWDRENEKINQSLAFIRKSDELLHNV

SEQ ID NO: 760 - protein, 36 aa, Artificial Sequence
  Core polypeptide
YISEVNEEINQSLAFIRKADELLENVDKWASLWNWF

SEQ ID NO: 761 - protein, 35 aa, Artificial Sequence
  Core polypeptide
TSVITIELSNIKENKANGTDAKVKLIKQELDKYKN

SEQ ID NO: 762 - protein, 38 aa, Artificial Sequence
  Core polypeptide
YTSLIHSLIEESQNQQEKNEQELLELDKWASLWNWFMG

SEQ ID NO: 763 - protein, 21 aa, Artificial Sequence
  Core polypeptide
NEKINQSLAFIRKSDELLHNV

SEQ ID NO: 764 - protein, 35 aa, Artificial Sequence; identical to SEQ ID NO: 104
  Core polypeptide

SEQ ID NO: 765 - protein, 35 aa, Artificial Sequence; identical to SEQ ID NO: 106
  Core polypeptide

SEQ ID NO: 766 - protein, 35 aa, Artificial Sequence; identical to SEQ ID NO: 108
  Core polypeptide

SEQ ID NO: 767 - protein, 35 aa, Artificial Sequence; identical to SEQ ID NO: 112
  Core polypeptide

SEQ ID NO: 768 - protein, 35 aa, Artificial Sequence; identical to SEQ ID NO: 718
  Core polypeptide

SEQ ID NO: 769 - protein, 35 aa, Artificial Sequence; identical to SEQ ID NO: 692
  Core polypeptide

SEQ ID NO: 770 - protein, 35 aa, Artificial Sequence
  Core polypeptide
VYPSDEFDASISQVQEEIQQALAFIRKADELLEQV

SEQ ID NO: 771 - protein, 37 aa, Artificial Sequence
  Core polypeptide
NYTSLIHSLIEESQNQQEKNEQELLELDKWASLWNWF

SEQ ID NO: 772 - protein, 38 aa, Artificial Sequence
  Core polypeptide
NNYTSLIHSLIEESQNQQEKNEQELLELDKWASLWNWF

SEQ ID NO: 773 - protein, 39 aa, Artificial Sequence
  Core polypeptide
INNYTSLIHSLIEESQNQQEKNEQELLELDKWASLWNWF

SEQ ID NO: 774 - protein, 40 aa, Artificial Sequence
  Core polypeptide
EINNYTSLIHSLIEESQNQQEKNEQELLELDKWASLWNWF

SEQ ID NO: 775 - protein, 37 aa, Artificial Sequence
  Core polypeptide
YTSLIHSLIEESQNQQEKNEQELLELDKWASLWNWFN

SEQ ID NO: 776 - protein, 38 aa, Artificial Sequence
  Core polypeptide
YTSLIHSLIEESQNQQEKNEQELLELDKWASLWNWFNI

SEQ ID NO: 777 - protein, 39 aa, Artificial Sequence
  Core polypeptide
YTSLIHSLIEESQNQQEKNEQELLELDKWASLWNWFNIT

SEQ ID NO: 778 - protein, 40 aa, Artificial Sequence
  Core polypeptide
YTSLIHSLIEESQNQQEKNEQELLELDKWASLWNWFNITN

SEQ ID NO: 779 - protein, 43 aa, Artificial Sequence
  Core polypeptide
YDPLVFPSDEFDASISQVNEKINQSLAFIRKSDELLHNVNAGK

SEQ ID NO: 780 - protein, 38 aa, Artificial Sequence
  Core polypeptide
NYTSLIHSLIEESQNQQEKNEQELLELDKWASLWNWFN

SEQ ID NO: 781 - protein, 40 aa, Artificial Sequence
  Core polypeptide
NNYTSLIHSLIEESQNQQEKNEQELLELDKWASLWNWFNI

SEQ ID NO: 782 - protein, 49 aa, Artificial Sequence
  Core polypeptide
KCRAKFKQLLQHYREVAAAKSSENDRLRLLLKQMCPSLDVDSIIPRTPD

SEQ ID NO: 783 - protein, 47 aa, Artificial Sequence
  Core polypeptide
RAKFKQLLQHYREVAAAKSSENDRLRLLLKQMCPSLDVDSIIPRTPD

SEQ ID NO: 784 - protein, 35 aa, Artificial Sequence
  Core polypeptide
VYPSDEYDASISQVNEEINQALAYIAAADELLENV

SEQ ID NO: 785 - protein, 26 aa, Artificial Sequence
  Core polypeptide
YDASISQVNEEINQALAYIRKADELL

SEQ ID NO: 786 - protein, 40 aa, Artificial Sequence
  Core polypeptide
MNLEWMEWDREINNYTSLIHSLIEESQNQQEKNEQELLEL

SEQ ID NO: 787 - protein, 34 aa, Artificial Sequence
  Core polypeptide
KNGTYDYPKYEEESKLNRNEIKGVKLSSMGVYQI

SEQ ID NO: 788 - protein, 35 aa, Artificial Sequence
  Core polypeptide
VTEKIQMASDNINDLIQSGVNTRLLTIQSHVQNYI

SEQ ID NO: 789 - protein, 24 aa, Artificial Sequence
  Core polypeptide
QNQQEKNEQELLELDKWASLWNWF

SEQ ID NO: 790 - protein, 24 aa, Artificial Sequence
  Core polypeptide
QNQQEKNEQELLELDKWASLWNWF

SEQ ID NO: 791 - protein, 5 aa, Artificial Sequence
  Core polypeptide
LWNWF

SEQ ID NO: 792 - protein, 15 aa, Artificial Sequence
  Core polypeptide
ELLELDKWASLWNWF

SEQ ID NO: 793 - protein, 20 aa, Artificial Sequence
  Core polypeptide
EKNEQELLELDKWASLWNWF

SEQ ID NO: 794 - protein, 30 aa, Artificial Sequence
  Core polypeptide
SLIEESQNQQEKNEQELLELDKWASLWNWF

SEQ ID NO: 795 - protein, 35 aa, Artificial Sequence
  Core polypeptide
YTSLIHSLIEESQNQQEKNEQELLELDKWASLWNW

SEQ ID NO: 796 - protein, 34 aa, Artificial Sequence; identical to SEQ ID NO: 741
  Core polypeptide

SEQ ID NO: 797 - protein, 33 aa, Artificial Sequence; identical to SEQ ID NO: 742
  Core polypeptide

SEQ ID NO: 798 - protein, 32 aa, Artificial Sequence; identical to SEQ ID NO: 743
  Core polypeptide

SEQ ID NO: 799 - protein, 35 aa, Artificial Sequence; identical to SEQ ID NO: 638
  Core polypeptide

SEQ ID NO: 800 - protein, 34 aa, Artificial Sequence
  Core polypeptide
SLIHSLIEESQNQQEKNEQELLELDKWASLWNWF

SEQ ID NO: 801 - protein, 33 aa, Artificial Sequence; identical to SEQ ID NO: 61
  Core polypeptide

SEQ ID NO: 802 - protein, 32 aa, Artificial Sequence
  Core polypeptide
IHSLIEESQNQQEKNEQELLELDKWASLWNWF

SEQ ID NO: 803 - protein, 51 aa, Artificial Sequence
  Core polypeptide
AAVALLPAVLLALLAPSELEIKRYKNRVASRKCRAKFKQLLQHYREVAAAK

SEQ ID NO: 804 - protein, 51 aa, Artificial Sequence
  Core polypeptide
AAVALLPAVLLALLAPCRAKFKQLLQHYREVAAAKSSENDRLRLLLKQMCP

SEQ ID NO: 805 - protein, 36 aa, Artificial Sequence
  Core polypeptide
YTSLIHSLIEESQNQQEKNNNIERDWEMWTMNNWIQ

SEQ ID NO: 806 - protein, 35 aa, Artificial Sequence; identical to SEQ ID NO: 692
  Core polypeptide

SEQ ID NO: 807 - protein, 35 aa, Artificial Sequence
  Core polypeptide
LMQLARQLMQLARQMKQLADSLMQLARQVSRLESA

SEQ ID NO: 808 - protein, 34 aa, Artificial Sequence
  Core polypeptide
WMEWDREINNYTSLIHSLIEESQNQQEKNEQELL

SEQ ID NO: 809 - protein, 35 aa, Artificial Sequence
  Core polypeptide
MEWDREINNYTSLIHSLIEESQNQQEKNEQELLEL

SEQ ID NO: 810 - protein, 34 aa, Artificial Sequence
  Core polypeptide
EWDREINNYTSLIHSLIEESQNQQEKNEQELLEL

SEQ ID NO: 811 - protein, 34 aa, Artificial Sequence
  Core polypeptide
MEWDREINNYTSLIHSLIEESQNQQEKNEQELLE

SEQ ID NO: 812 - protein, 36 aa, Artificial Sequence
  Core polypeptide
WNEWDREINNYTSLIHSLIEESQNQQEKNEQELLEL

SEQ ID NO: 813 - protein, 36 aa, Artificial Sequence
  Core polypeptide
YLEYDREINNYTSLIHSLIEESQNQQEKNEQELLEL

SEQ ID NO: 814 - protein, 17 aa, Artificial Sequence
  Core polypeptide
IKQFINMWQEVGKAMYA

SEQ ID NO: 815 - protein, 8 aa, Artificial Sequence
  Core polypeptide
IRKSDELL

SEQ ID NO: 816 - protein, 8 aa, Artificial Sequence
  Core polypeptide
YDASISQV

SEQ ID NO: 817 - protein, 8 aa, Artificial Sequence
  Core polypeptide
NEKINQSL

SEQ ID NO: 818 - protein, 23 aa, Artificial Sequence
  Core polypeptide
SISQVNEEINQALAYIRKADELL

SEQ ID NO: 819 - protein, 20 aa, Artificial Sequence
  Core polypeptide
QVNEEINQALAYIRKADELL

SEQ ID NO: 820 - protein, 17 aa, Artificial Sequence
  Core polypeptide
EEINQALAYIRKADELL

SEQ ID NO: 821 - protein, 14 aa, Artificial Sequence
  Core polypeptide
NQALAYIRKADELL

SEQ ID NO: 822 - protein, 11 aa, Artificial Sequence
  Core polypeptide
LAYIRKADELL

SEQ ID NO: 823 - protein, 26 aa, Artificial Sequence
  Core polypeptide
FDASISQVNEKINQALAFIRKSDELL

SEQ ID NO: 824 - protein, 36 aa, Artificial Sequence; identical to SEQ ID NO: 812
  Core polypeptide

SEQ ID NO: 825 - protein, 45 aa, Artificial Sequence
  Core polypeptide
ASRKCRAKFKQLLQHYREVAAAKSSENDRLRLLLKQMCPSLDVDS

SEQ ID NO: 826 - protein, 4 aa, Artificial Sequence
  Core polypeptide
ZFFG

SEQ ID NO: 827 - protein, 36 aa, Artificial Sequence
  Core polypeptide
WLEWDREINNYTSLIHSLIEESQNQQEKNEQELLEL

SEQ ID NO: 828 - protein, 36 aa, Artificial Sequence
  Core polypeptide
YVKGEPIINFYDPLVFPSDEFDASISQVNEKINQSL

SEQ ID NO: 829 - protein, 35 aa, Artificial Sequence
  Core polypeptide
VYPSDEYDASISQVNEEINQSLAYIRKADELLHNV

SEQ ID NO: 830 - protein, 29 aa, Artificial Sequence
  Core polypeptide
YDASISQVNEEINQALAYIRKADELLENV

SEQ ID NO: 831 - protein, 27 aa, Artificial Sequence
  Core polypeptide
YDASISQVNEEINQALAYIRKADELLE

SEQ ID NO: 832 - protein, 35 aa, Artificial Sequence
  Core polypeptide
VYPSDEYDASISQVNEEINQALAYIRKAAELLHNV

SEQ ID NO: 833 - protein, 35 aa, Artificial Sequence
  Core polypeptide
VYPSDEYDASISQVNEEINQALAYIRKALELLHNV

SEQ ID NO: 834 - protein, 36 aa, Artificial Sequence; identical to SEQ ID NO: 15
  Core polypeptide

SEQ ID NO: 835 - protein, 35 aa, Artificial Sequence
  Core polypeptide
VYPSDEYDASISQVNEEINQLLAYIRKLDELLENV

SEQ ID NO: 836 - protein, 28 aa, Artificial Sequence
  Core polypeptide
DEYDASISQVNEKINQSLAFIRKSDELL

SEQ ID NO: 837 - protein, 35 aa, Artificial Sequence
  Core polypeptide
SNDQGSGYAADKESTQKAFDGITNKVNSVIEKTNT

SEQ ID NO: 838 - protein, 38 aa, Artificial Sequence
  Core polypeptide
ESTQKAFDGITNKVNSVIEKTNTQFEAVGKEFGNLEKR

SEQ ID NO: 839 - protein, 37 aa, Artificial Sequence
  Core polypeptide
DGITNKVNSVIEKTNTQFEAVGKEFGNLEKRLENLNK

SEQ ID NO: 840 - protein, 32 aa, Artificial Sequence
  Core polypeptide
DSNVKNLYDKVRSQLRDNVKELGNGAFEFYHK

SEQ ID NO: 841 - protein, 36 aa, Artificial Sequence
  Core polypeptide
RDNVKELGNGAFEFYHKADDEALNSVKNGTYDYPKY

SEQ ID NO: 842 - protein, 24 aa, Artificial Sequence
  Core polypeptide
EFYHKADDEALNSVKNGTYDYPKY

SEQ ID NO: 843 - protein, 36 aa, Artificial Sequence
  Core polypeptide
AAVALLPAVLLALLAPAADKESTQKAFDGITNKVNS

SEQ ID NO: 844 - protein, 36 aa, Artificial Sequence
  Core polypeptide
AAVALLPAVLLALLAPAADSNVKNLYDKVRSQLRDN

SEQ ID NO: 845 - protein, 18 aa, Artificial Sequence
  Core polypeptide
KESTQKAFDGITNKVNSV

SEQ ID NO: 846 - protein, 20 aa, Artificial Sequence
  Core polypeptide
IEKTNTQFEAVGKEFGNLER

SEQ ID NO: 847 - protein, 30 aa, Artificial Sequence
  Core polypeptide
RLENLNKRVEDGFLDVWTYNAELLVALENE

SEQ ID NO: 848 - protein, 17 aa, Artificial Sequence
  Core polypeptide
SNVKNLYDKVRSQLRDN

SEQ ID NO: 849 - protein, 33 aa, Artificial Sequence
  Core polypeptide
WMEWDREINNYTSLIHSLIEESQNQQEKNEQEL

SEQ ID NO: 850 - protein, 32 aa, Artificial Sequence
  Core polypeptide
WMEWDREINNYTSLIHSLIEESQNQQEKNEQE

SEQ ID NO: 851 - protein, 32 aa, Artificial Sequence
  Core polypeptide
MEWDREINNYTSLIHSLIEESQNQQEKNEQEL

SEQ ID NO: 852 - protein, 31 aa, Artificial Sequence
  Core polypeptide
MEWDREINNYTSLIHSLIEESQNQQEKNEQE

SEQ ID NO: 853 - protein, 33 aa, Artificial Sequence
  Core polypeptide
EWDREINNYTSLIHSLIEESQNQQEKNEQELLE

SEQ ID NO: 854 - protein, 32 aa, Artificial Sequence
  Core polypeptide
EWDREINNYTSLIHSLIEESQNQQEKNEQELL

SEQ ID NO: 855 - protein, 31 aa, Artificial Sequence
  Core polypeptide
EWDREINNYTSLIHSLIEESQNQQEKNEQEL

SEQ ID NO: 856 - protein, 36 aa, Artificial Sequence
  Core polypeptide
YTKFIYTLLEESQNQQEKNEQELLELDKWASLWNWF

SEQ ID NO: 857 - protein, 22 aa, Artificial Sequence
  Core polypeptide
YMKQLADSLMQLARQVSRLESA

SEQ ID NO: 858 - protein, 29 aa, Artificial Sequence
  Core polypeptide
YLMQLARQMKQLADSLMQLARQVSRLESA

SEQ ID NO: 859 - protein, 36 aa, Artificial Sequence
  Core polypeptide
YQEWERKVDFLEENITALLEEAQIQQEKNMYELQKL

SEQ ID NO: 860 - protein, 36 aa, Artificial Sequence
  Core polypeptide
WMAWAAAINNYTSLIHSLIEESQNQQEKNEQEEEEE

SEQ ID NO: 861 - protein, 36 aa, Artificial Sequence
  Core polypeptide
YASLIAALIEESQNQQEKNEQELLELAKWAALWAWF

SEQ ID NO: 862 - protein, 38 aa, Artificial Sequence
  Core polypeptide
EWDREINNYTSLIHSLIEESQNQQEKNEQEGGCDIMER

SEQ ID NO: 863 - protein, 35 aa, Artificial Sequence
  Core polypeptide
YDISIELNKAKSDLEESKEWIKKSNQKLDSIGNWH

SEQ ID NO: 864 - protein, 35 aa, Artificial Sequence; identical to SEQ ID NO: 548
  Core polypeptide

SEQ ID NO: 865 - protein, 6 aa, Artificial Sequence
  Core polypeptide
YTSLIH

SEQ ID NO: 866 - protein, 7 aa, Artificial Sequence
  Core polypeptide
HSLIEEH

SEQ ID NO: 867 - protein, 8 aa, Artificial Sequence
  Core polypeptide
SQNQQEKH

SEQ ID NO: 868 - protein, 9 aa, Artificial Sequence
  Core polypeptide
NEQELLELH

SEQ ID NO: 869 - protein, 7 aa, Artificial Sequence
  Core polypeptide
DKWASLH

SEQ ID NO: 870 - protein, 5 aa, Artificial Sequence
  Core polypeptide
WNWFH

SEQ ID NO: 871 - protein, 36 aa, Artificial Sequence
  Core polypeptide
AKTLERTWDTLNHLLFISSALYKLNLKSVAQITLSI

SEQ ID NO: 872 - protein, 24 aa, Artificial Sequence
  Core polypeptide
NITLQAKIKQFINMWQEVGKAMYA

SEQ ID NO: 873 - protein, 28 aa, Artificial Sequence
  Core polypeptide
LENERTLDFHDSNVKNLYDKVRLQLRDN

SEQ ID NO: 874 - protein, 35 aa, Artificial Sequence
  Core polypeptide
LENERTLDFHDSNVKNLYDKVRLQLRDNVKELGNG

SEQ ID NO: 875 - protein, 34 aa, Artificial Sequence
  Core polypeptide
TLDFHDSNVKNLYDKVRLQLRDNVKELGNGAFEF

SEQ ID NO: 876 - protein, 26 aa, Artificial Sequence
  Core polypeptide
FDASISQVNEKINQALAFIRKSDELL

SEQ ID NO: 877 - protein, 23 aa, Artificial Sequence
  Core polypeptide
SISQVNEEINQALAYIRKADELL

SEQ ID NO: 878 - protein, 23 aa, Artificial Sequence
  Core polypeptide
SISQVNEEINQSLAYIRKSDELL

SEQ ID NO: 879 - protein, 23 aa, Artificial Sequence
  Core polypeptide
SISQVNEEINQSLAYIRKSDELL

SEQ ID NO: 880 - protein, 35 aa, Artificial Sequence
  Core polypeptide
NSVALDPIDISIELNKAKSDLEESKEWIKKSNQKL

SEQ ID NO: 881 - protein, 35 aa, Artificial Sequence
  Core polypeptide
ALDPIDISIELNKAKSDLEESKEWIKKSNQKLDSI

SEQ ID NO: 882 - protein, 35 aa, Artificial Sequence; identical to SEQ ID NO: 880
  Core polypeptide

SEQ ID NO: 883 - protein, 35 aa, Artificial Sequence; identical to SEQ ID NO: 881
  Core polypeptide

SEQ ID NO: 884 - protein, 26 aa, Artificial Sequence
  Core polypeptide
YDASISQVNEEINQALAYIRKADELL

SEQ ID NO: 885 - protein, 26 aa, Artificial Sequence
  Core polypeptide
YDASISQVNEEINQSLAFIRKSDELL

SEQ ID NO: 886 - protein, 26 aa, Artificial Sequence
  Core polypeptide
YDASISQVNEEINQSLAFIRKSDELL

SEQ ID NO: 887 - protein, 33 aa, Artificial Sequence
  Core polypeptide
WLEWDREINNYTSLIHSLIEESQNQQEKNEQEL

SEQ ID NO: 888 - protein, 35 aa, Artificial Sequence; identical to SEQ ID NO: 202
  Core polypeptide

SEQ ID NO: 889 - protein, 35 aa, Artificial Sequence; identical to SEQ ID NO: 880
  Core polypeptide

SEQ ID NO: 890 - protein, 26 aa, Artificial Sequence
  Core polypeptide
YDASISQVNEEINQALAYIRKADELL

SEQ ID NO: 891 - protein, 28 aa, Artificial Sequence
  Core polypeptide
DEYDASISQVNEKINQSLAFIRKSDELL

SEQ ID NO: 892 - protein, 33 aa, Artificial Sequence
  Core polypeptide
WQEWEQKVRYLEANISQSLEQAQIQQEKNMYEL

SEQ ID NO: 893 - protein, 33 aa, Artificial Sequence
  Core polypeptide
WQEWEQKVRYLEANISQSLEQAQIQQEKNEYEL

SEQ ID NO: 894 - protein, 33 aa, Artificial Sequence
  Core polypeptide
WQEWEQKVRYLEANITALLEQAQIQQEKNEYEL

SEQ ID NO: 895 - protein, 33 aa, Artificial Sequence
  Core polypeptide
WQEWEQKVRYLEANITALLEQAQIQQEKNMYEL

SEQ ID NO: 896 - protein, 36 aa, Artificial Sequence
  Core polypeptide
WQEWEQKVRYLEANISQSLEQAQIQQEKNEYELQKL

SEQ ID NO: 897 - protein, 36 aa, Artificial Sequence
  Core polypeptide
WQEWEQKVRYLEANITALLEQAQIQQEKNEYELQKL

SEQ ID NO: 898 - protein, 36 aa, Artificial Sequence
  Core polypeptide
WQEWEQKVRYLEANITALLEQAQIQQEKNMYELQKL

SEQ ID NO: 899 - protein, 37 aa, Artificial Sequence
  Core polypeptide
EFGNLEKRLENLNKRVEDGFLDVWTYNAELLVALENE

SEQ ID NO: 900 - protein, 42 aa, Artificial Sequence
  Core polypeptide
EDGFLDVWTYNAELLVLMENERTLDFHDSNVKNLYDKVRMQL

SEQ ID NO: 901 - protein, 23 aa, Artificial Sequence
  Core polypeptide
SISQVNEKINQSLAFIRKSDELL

SEQ ID NO: 902 - protein, 23 aa, Artificial Sequence
  Core polypeptide
SISQVNEKINQSLAFIRKSDELL

SEQ ID NO: 903 - protein, 23 aa, Artificial Sequence
  Core polypeptide
SISQVNEKINQSLAYIRKSDELL

SEQ ID NO: 904 - protein, 38 aa, Artificial Sequence
  Core polypeptide
QQLLDVVKRQQEMLRLTVWGTKNLQARVTAIEKYLKDQ

SEQ ID NO: 905 - protein, 37 aa, Artificial Sequence
  Core polypeptide
YTSLIHSLIEESQNQQEKNEQELLELDKWASLWNWFC

SEQ ID NO: 906 - protein, 26 aa, Artificial Sequence
  Core polypeptide
FDASISQVNEKINQSLAYIRKSDELL

SEQ ID NO: 907 - protein, 30 aa, Artificial Sequence
  Core polypeptide
YTSLIHSLIEESQNQQEKNEQELLELDKWA

SEQ ID NO: 908 - protein, 28 aa, Artificial Sequence
  Core polypeptide
DEFDASISQVNEKINQSLAFIRKSDELL

SEQ ID NO: 909 - protein, 28 aa, Artificial Sequence
  Core polypeptide
DEFDESISQVNEKINQSLAFIRKSDELL

SEQ ID NO: 910 - protein, 28 aa, Artificial Sequence
  Core polypeptide
DEFDESISQVNEKIEQSLAFIRKSDELL

SEQ ID NO: 911 - protein, 28 aa, Artificial Sequence
  Core polypeptide
DEFDESISQVNEKIEESLAFIRKSDELL

SEQ ID NO: 912 - protein, 28 aa, Artificial Sequence
  Core polypeptide
DEFDESISQVNEKIEESLQFIRKSDELL

SEQ ID NO: 913 - protein, 33 aa, Artificial Sequence
  Core polypeptide
GGGGGDEFDASISQVNEKINQSLAFIRKSDELL

SEQ ID NO: 914 - protein, 28 aa, Artificial Sequence
  Core polypeptide
DEFDASISQVNEKINQSLAFIRKSDELL

SEQ ID NO: 915 - protein, 28 aa, Artificial Sequence
  Core polypeptide
DEFDASISQVNEKINQSLAFIRKSDELL

SEQ ID NO: 916 - protein, 35 aa, Artificial Sequence; identical to SEQ ID NO: 198
  Core polypeptide

SEQ ID NO: 917 - protein, 35 aa, Artificial Sequence
  Core polypeptide
YDASISQVNEKINQALAYIRKADELLHNVNAGKST

SEQ ID NO: 918 - protein, 35 aa, Artificial Sequence
  Core polypeptide
VYPSDEYDASISQVNEKINQALAYIRKADELLHNV

SEQ ID NO: 919 - protein, 8 aa, Artificial Sequence
  Core polypeptide
WGWGYGYG

SEQ ID NO: 920 - protein, 9 aa, Artificial Sequence
  Core polypeptide
YGWGWGWGF

SEQ ID NO: 921 - protein, 36 aa, Artificial Sequence
  Core polypeptide
WQEWEQKVRYLEANITALQEQAQIQAEKAEYELQKL

SEQ ID NO: 922 - protein, 36 aa, Artificial Sequence
  Core polypeptide
WQEWEQKVRYLEAEITALQEEAQIQAEKAEYELQKL

SEQ ID NO: 923 - protein, 31 aa, Artificial Sequence; identical to SEQ ID NO: 744
  Core polypeptide

SEQ ID NO: 924 - protein, 35 aa, Artificial Sequence
  Core polypeptide
VWPSDEFDASISQVNEKINQSLAFIRKSDELLHNV

SEQ ID NO: 925 - protein, 35 aa, Artificial Sequence
  Core polypeptide
SKNISEQIDQIKKDEQKEGTGWGLGGKWWTSDWGV

SEQ ID NO: 926 - protein, 35 aa, Artificial Sequence
  Core polypeptide
LSKNISEQIDQIKKDEQKEGTGWGLGGKWWTSDWG

SEQ ID NO: 927 - protein, 35 aa, Artificial Sequence
  Core polypeptide
DLSKNISEQIDQIKKDEQKEGTGWGLGGKWWTSDW

SEQ ID NO: 928 - protein, 35 aa, Artificial Sequence
  Core polypeptide
EDLSKNISEQIDQIKKDEQKEGTGWGLGGKWWTSD

SEQ ID NO: 929 - protein, 35 aa, Artificial Sequence
  Core polypeptide
IEDLSKNISEQIDQIKKDEQKEGTGWGLGGKWWTS

SEQ ID NO: 930 - protein, 35 aa, Artificial Sequence
  Core polypeptide
GIEDLSKNISEQIDQIKKDEQKEGTGWGLGGKWWT

SEQ ID NO: 931 - protein, 35 aa, Artificial Sequence
  Core polypeptide
IGIEDLSKNISEQIDQIKKDEQKEGTGWGLGGKWW

SEQ ID NO: 932 - protein, 34 aa, Artificial Sequence
  Core polypeptide
PSDEFDASISQVNEKINQSLAFIRKSDELLHNVN

SEQ ID NO: 933 - protein, 35 aa, Artificial Sequence
  Core polypeptide
VYPSDEYDASISQVNEKINQALAYIRKADELLENV

SEQ ID NO: 934 - protein, 35 aa, Artificial Sequence
  Core polypeptide
VYPSDEFDASISQVNEKINQALAFIRKADELLENV

SEQ ID NO: 935 - protein, 35 aa, Artificial Sequence
  Core polypeptide
VYPSDEYDASISQVNEKINQALAYIREADELLENV

SEQ ID NO: 936 - protein, 26 aa, Artificial Sequence
  Core polypeptide
YDASISQVNEKINQSLAFIRESDELL

SEQ ID NO: 937 - protein, 35 aa, Artificial Sequence
  Core polypeptide
AIGIEDLSKNISEQIDQIKKDEQKEGTGWGLGGKW

SEQ ID NO: 938 - protein, 35 aa, Artificial Sequence
  Core polypeptide
AAIGIEDLSKNISEQIDQIKKDEQKEGTGWGLGGK

SEQ ID NO: 939 - protein, 35 aa, Artificial Sequence
  Core polypeptide
DAAIGIEDLSKNISEQIDQIKKDEQKEGTGWGLGG

SEQ ID NO: 940 - protein, 35 aa, Artificial Sequence
  Core polypeptide
PDAAIGIEDLSKNISEQIDQIKKDEQKEGTGWGLG

SEQ ID NO: 941 - protein, 35 aa, Artificial Sequence
  Core polypeptide
NITDKIDQIIHDFVDKTLPDQGDNDNWWTGWRQWI

SEQ ID NO: 942 - protein, 35 aa, Artificial Sequence
  Core polypeptide
KNITDKIDQIIHDFVDKTLPDQGDNDNWWTGWRQW

SEQ ID NO: 943 - protein, 35 aa, Artificial Sequence
  Core polypeptide
TKNITDKIDQIIHDFVDKTLPDQGDNDNWWTGWRQ

SEQ ID NO: 944 - protein, 35 aa, Artificial Sequence
  Core polypeptide
WTKNITDKIDQIIHDFVDKTLPDQGDNDNWWTGWR

SEQ ID NO: 945 - protein, 35 aa, Artificial Sequence
  Core polypeptide
DWTKNITDKIDQIIHDFVDKTLPDQGDNDNWWTGW

SEQ ID NO: 946 - protein, 35 aa, Artificial Sequence
  Core polypeptide
HDWTKNITDKIDQIIHDFVDKTLPDQGDNDNWWTG

SEQ ID NO: 947 - protein, 35 aa, Artificial Sequence
  Core polypeptide
PHDWTKNITDKIDQIIHDFVDKTLPDQGDNDNWWT

SEQ ID NO: 948 - protein, 35 aa, Artificial Sequence
  Core polypeptide
EPHDWTKNITDKIDQIIHDFVDKTLPDQGDNDNWW

SEQ ID NO: 949 - protein, 35 aa, Artificial Sequence
  Core polypeptide
IEPHDWTKNITDKIDQIIHDFVDKTLPDQGDNDNW

SEQ ID NO: 950 - protein, 35 aa, Artificial Sequence
  Core polypeptide
AIEPHDWTKNITDKIDQIIHDFVDKTLPDQGDNDN

SEQ ID NO: 951 - protein, 35 aa, Artificial Sequence
  Core polypeptide
AAIEPHDWTKNITDKIDQIIHDFVDKTLPDQGDND

SEQ ID NO: 952 - protein, 35 aa, Artificial Sequence
  Core polypeptide
DAAIEPHDWTKNITDKIDQIIHDFVDKTLPDQGDN

SEQ ID NO: 953 - protein, 35 aa, Artificial Sequence
  Core polypeptide
LSPTVWLSVIWMMWYWGPSLYSILSPFLPLLPIFF

SEQ ID NO: 954 - protein, 45 aa, Artificial Sequence
  Core polypeptide
HNHTTWMEWDREINNYTSLIHSLIEESQNQQEKNEQELLELDKWH

SEQ ID NO: 955 - protein, 53 aa, Artificial Sequence
  Core polypeptide
HQARQLLSGIVQQQNNLLRAIEAQQHLLQLTVWGIKQLQARILAVERYLKDQH

SEQ ID NO: 956 - protein, 35 aa, Artificial Sequence
  Core polypeptide
VYPSDEFDASISQVNEKINQSLAFIREADELLENV

SEQ ID NO: 957 - protein, 35 aa, Artificial Sequence
  Core polypeptide
VFPSDEFDASISQVNEKINQSLAYIREADELLENV

SEQ ID NO: 958 - protein, 28 aa, Artificial Sequence
  Core polypeptide
DEFDASISQVNEKINQSLAYIREADELL

SEQ ID NO: 959 - protein, 50 aa, Artificial Sequence
  Core polypeptide
NEQELLELDKWASLWNWFGGGGDEFDASISQVNEKINQSLAFIRKSDELL

SEQ ID NO: 960 - protein, 45 aa, Artificial Sequence
  Core polypeptide
LELDKWASLWNWFGGGGDEFDASISQVNEKINQSLAFIRKSDELL

SEQ ID NO: 961 - protein, 36 aa, Artificial Sequence
  Core polypeptide
EGEGEGEGDEFDASISQVNEKINQSLAFIRKSDELL

SEQ ID NO: 962 - protein, 43 aa, Artificial Sequence
  Core polypeptide
ASRKCRAKFKQLLQHYREVAAAKSSENDRLRLLLKQMCPSLDV

SEQ ID NO: 963 - protein, 29 aa, Artificial Sequence
  Core polypeptide
GDEEDASISQVNEKINQSLAFIRKSDELL

SEQ ID NO: 964 - protein, 29 aa, Artificial Sequence
  Core polypeptide
GDEEDASESQVNEKINQSLAFIRKSDELL

SEQ ID NO: 965 - protein, 29 aa, Artificial Sequence
  Core polypeptide
GDEEDASESQQNEKINQSLAFIRKSDELL

SEQ ID NO: 966 - protein, 29 aa, Artificial Sequence
  Core polypeptide
GDEEDASESQQNEKQNQSLAFIRKSDELL

SEQ ID NO: 967 - protein, 29 aa, Artificial Sequence
  Core polypeptide
GDEEDASESQQNEKQNQSEAFIRKSDELL

SEQ ID NO: 968 - protein, 30 aa, Artificial Sequence
  Core polypeptide
WGDEFDESISQVNEKIEESLAFIRKSDELL

SEQ ID NO: 969 - protein, 40 aa, Artificial Sequence
  Core polypeptide
YTSLGGDEFDESISQVNEKIEESLAFIRKSDELLGGWNWF

SEQ ID NO: 970 - protein, 48 aa, Artificial Sequence
  Core polypeptide
YTSLIHSLGGDEFDESISQVNEKIEESLAFIRKSDELLGGWASLWNWF

SEQ ID NO: 971 - protein, 29 aa, Artificial Sequence
  Core polypeptide
GDEFDESISQVNEKIEESLAFIRKSDELL

SEQ ID NO: 972 - protein, 29 aa, Artificial Sequence
  Core polypeptide
GDEEDESISQVNEKIEESLAFIRKSDELL

SEQ ID NO: 973 - protein, 29 aa, Artificial Sequence
  Core polypeptide
GDEEDESISQVQEKIEESLAFIRKSDELL

SEQ ID NO: 974 - protein, 29 aa, Artificial Sequence
  Core polypeptide
GDEEDESISQVQEKIEESLLFIRKSDELL

SEQ ID NO: 975 - protein, 29 aa, Artificial Sequence
  Core polypeptide
GDEYDESISQVNEKIEESLAFIRKSDELL

SEQ ID NO: 976 - protein, 29 aa, Artificial Sequence
  Core polypeptide
GDEYDESISQVNEKIEESLAFIRKSDELL

SEQ ID NO: 977 - protein, 36 aa, Artificial Sequence
  Core polypeptide
YTSLIHSLIDEQEKIEELAFIRKSDELLELDKWNWF

SEQ ID NO: 978 - protein, 35 aa, Artificial Sequence; identical to SEQ ID NO: 692
  Core polypeptide

SEQ ID NO: 979 - protein, 38 aa, Artificial Sequence
  Core polypeptide
NNLLRAIEAQQHLLQLTVWGSKQLQARILAVERYLKDQ

SEQ ID NO: 980 - protein, 38 aa, Artificial Sequence
  Core polypeptide
GGGVYPSDEYDASISQVNEEINQALAYIRKADELLENV

SEQ ID NO: 981 - protein, 38 aa, Artificial Sequence
  Core polypeptide
NNLLRAIEAQQHLLQLTVWGEKQLQARILAVERYLKDQ

SEQ ID NO: 982 - protein, 28 aa, Artificial Sequence
  Core polypeptide
PTRVNYILIIGVLVLAEVTGVRADVHLL

SEQ ID NO: 983 - protein, 35 aa, Artificial Sequence
  Core polypeptide
PTRVNYILIIGVLVLAEVTGVRADVHLLEQPGNLW

SEQ ID NO: 984 - protein, 36 aa, Artificial Sequence
  Core polypeptide
PEKTPLLPTRVNYILIIGVLVLABEVTGVRADVHLL

SEQ ID NO: 985 - protein, 38 aa, Artificial Sequence; identical to SEQ ID NO: 980
  Core polypeptide

SEQ ID NO: 986 - protein, 38 aa, Artificial Sequence
  Core polypeptide
YTSLIHSLGGDEFDESISQVNEKIEESLAFIRKSDELL

SEQ ID NO: 987 - protein, 34 aa, Artificial Sequence
  Core polypeptide
YTSLGGDEFDESISQVNEKIEESLAFIRKSDELL

SEQ ID NO: 988 - protein, 38 aa, Artificial Sequence
  Core polypeptide
DEFDESISQVNEKIEESLAFIRKSDELLGGWASLWNWF

SEQ ID NO: 989 - protein, 34 aa, Artificial Sequence
  Core polypeptide
DEFDESISQVNEKIEESLAFIRKSDELLGGWNWF

SEQ ID NO: 990 - protein, 35 aa, Artificial Sequence
  Core polypeptide
YTSLIHSLIEESQNQQEKNEQELLELDKASLWNWF

SEQ ID NO: 991 - protein, 34 aa, Artificial Sequence
  Core polypeptide
YTSLIHSLIEESQNQQEKNEQELLELDKSLWNWF

SEQ ID NO: 992 - protein, 33 aa, Artificial Sequence
  Core polypeptide
YTSLIHSLIEESQNQQEKNEQELLELDKLWNWF

SEQ ID NO: 993 - protein, 32 aa, Artificial Sequence
  Core polypeptide
YTSLIHSLIEESQNQQEKNEQELLELDKWNWF

SEQ ID NO: 994 - protein, 47 aa, Artificial Sequence
  Core polypeptide
MTWMEWDREINNYTSLIHSLIEESQNQQEKNEQELLELDKASLWNWF

SEQ ID NO: 995 - protein, 46 aa, Artificial Sequence
  Core polypeptide
MTWMEWDREINNYTSLIHSLIEESQNQQEKNEQELLELDKSLWNWF

SEQ ID NO: 996 - protein, 45 aa, Artificial Sequence
  Core polypeptide
MTWMEWDREINNYTSLIHSLIEESQNQQEKNEQELLELDKLWNWF

SEQ ID NO: 997 - protein, 44 aa, Artificial Sequence
  Core polypeptide
MTWMEWDREINNYTSLIHSLIEESQNQQEKNEQELLELDKWNWF

SEQ ID NO: 998 - protein, 46 aa, Artificial Sequence
  Core polypeptide
MTWMEWDREINNYTSLIHSLIEESQNQQEKNEQELLELDKWASLWN

SEQ ID NO: 999 - protein, 44 aa, Artificial Sequence
  Core polypeptide
MTWMEWDREINNYTSLIHSLIEESQNQQEKNEQELLELDKWASL

SEQ ID NO: 1000 - protein, 8 aa, Artificial Sequence
  Core polypeptide
HWSYLRPG

SEQ ID NO: 1001 - protein, 36 aa, Artificial Sequence
  Core polypeptide
WNWFDEFDESISQVNEKIEESLAFIRKSDELLWNWF

SEQ ID NO: 1002 - protein, 36 aa, Artificial Sequence
  Core polypeptide
YTSLIHSLIEESQNQQEKNEQELLELDKYASLYNYF

SEQ ID NO: 1003 - protein, 36 aa, Artificial Sequence
  Core polypeptide
YTSLIHSLIEESQNQQEKNEQELLELDKYAYLYNYF

SEQ ID NO: 1004 - protein, 29 aa, Artificial Sequence
  Core polypeptide
DEFDESISQVNEKIEESLAFIRKSDELLW

SEQ ID NO: 1005 - protein, 31 aa, Artificial Sequence
  Core polypeptide
GDEFDESISQVNEKIEESLAFIRKSDELLGW

SEQ ID NO: 1006 - protein, 29 aa, Artificial Sequence
  Core polypeptide
GDEFDESISQVNEKIEESLAFIRESDELL

SEQ ID NO: 1007 - protein, 29 aa, Artificial Sequence
  Core polypeptide
GDEFDESISQVNEKIEESLAFIEESDELL

SEQ ID NO: 1008 - protein, 36 aa, Artificial Sequence
  Core polypeptide
WQEWEQKVNYLEANITALLEQAQIQQEKNEYELQKL

SEQ ID NO: 1009 - protein, 36 aa, Artificial Sequence
  Core polypeptide
WQEWEQKVDYLEANITALLEQAQIQQEKNEYELQKL

SEQ ID NO: 1010 - protein, 36 aa, Artificial Sequence
  Core polypeptide
WQEWEQKVRWLEANITALLEQAQIQQEKNEYELQKL

SEQ ID NO: 1011 - protein, 36 aa, Artificial Sequence
  Core polypeptide
WQEWEKQVRYLEANITALLEQAQIQQEKNEYELQKL

SEQ ID NO: 1012 - protein, 36 aa, Artificial Sequence
  Core polypeptide
WQEWEHQVRYLEANITALLEQAQIQQEKNEYELQKL

SEQ ID NO: 1013 - protein, 36 aa, Artificial Sequence
  Core polypeptide
WQEWEHKVRYLEANITALLEQAQIQQEKNEYELQKL

SEQ ID NO: 1014 - protein, 36 aa, Artificial Sequence
  Core polypeptide
WQEWDREVRYLEANITALLEQAQIQQEKNEYELQKL

SEQ ID NO: 1015 - protein, 36 aa, Artificial Sequence
  Core polypeptide
WQEWEREVRYLEANITALLEQAQIQQEKNEYELQKL

SEQ ID NO: 1016 - protein, 36 aa, Artificial Sequence
  Core polypeptide
WQEWERQVRYLEANITALLEQAQIQQEKNEYELQKL

SEQ ID NO: 1017 - protein, 36 aa, Artificial Sequence
  Core polypeptide
WQEWEQKVKYLEANITALLEQAQIQQEKNEYELQKL

SEQ ID NO: 1018 - protein, 36 aa, Artificial Sequence
  Core polypeptide
WQEWEQKVRFLEANITALLEQAQIQQEKNEYELQKL

SEQ ID NO: 1019 - protein, 35 aa, Artificial Sequence
  Core polypeptide
VNPSDEYDASISQVNEEINQALAYIRKADELLENV

SEQ ID NO: 1020 - protein, 35 aa, Artificial Sequence
  Core polypeptide
VNPSDENDASISQVNEEINQALAYIRKADELLENV

SEQ ID NO: 1021 - protein, 35 aa, Artificial Sequence
  Core polypeptide
VNPSDEYDASISQVNEEINQALANIRKADELLENV

SEQ ID NO: 1022 - protein, 36 aa, Artificial Sequence
  Core polypeptide
VYPSDEFDASISQVNEKINQSLAFIREADELLFNFF

SEQ ID NO: 1023 - protein, 36 aa, Artificial Sequence
  Core polypeptide
VYPSDEYDASISQVNEEINQALAYIRKADELLFNFF

SEQ ID NO: 1024 - protein, 36 aa, Artificial Sequence
  Core polypeptide
YTSLITALLEQAQIQQEKNEYELQKLDKWASLWNWF

SEQ ID NO: 1025 - protein, 36 aa, Artificial Sequence
  Core polypeptide
YTSLITALLEQAQIQQEKNEYELQKLDKWASLWEWF

SEQ ID NO: 1026 - protein, 36 aa, Artificial Sequence
  Core polypeptide
YTSLITALLEQAQIQQEKNEYELQKLDEWASLWEWF

SEQ ID NO: 1027 - protein, 36 aa, Artificial Sequence
  Core polypeptide
YTSLITALLEQAQIQQEKNEYELQELDEWASLWEWF

SEQ ID NO: 1028 - protein, 36 aa, Artificial Sequence
  Core polypeptide
YTSLITALLEEAQIQQEKNEYELQELDEWASLWEWF

SEQ ID NO: 1029 - protein, 28 aa, Artificial Sequence
  Core polypeptide
AAATALLEQAQIQQEKNEYELQKLAAAW

SEQ ID NO: 1030 - protein, 36 aa, Artificial Sequence
  Core polypeptide
WAAWEQKVRYLEANITALLEQAQIQQEKNEYELQKL

SEQ ID NO: 1031 - protein, 36 aa, Artificial Sequence
  Core polypeptide
WQEAAQKVRYLEANITALLEQAQIQQEKNEYELQKL

SEQ ID NO: 1032 - protein, 36 aa, Artificial Sequence
  Core polypeptide
WQEWAAKVRYLEANITALLEQAQIQQEKNEYELQKL

SEQ ID NO: 1033 - protein, 36 aa, Artificial Sequence
  Core polypeptide
WQEWEQKAAYLEANITALLEQAQIQQEKNEYELQKL

SEQ ID NO: 1034 - protein, 36 aa, Artificial Sequence
  Core polypeptide
WQEWEQKVAALEANITALLEQAQIQQEKNEYELQKL

SEQ ID NO: 1035 - protein, 29 aa, Artificial Sequence
  Core polypeptide
GDEFDASISQVNEKINQSLAFIRKSDELT

SEQ ID NO: 1036 - protein, 29 aa, Artificial Sequence
  Core polypeptide
GDEFDASISQVNEKINQSLAFTRKSDELT

SEQ ID NO: 1037 - protein, 29 aa, Artificial Sequence
  Core polypeptide
GDEFDASISQVNEKTNQSLAFTRKSDELT

SEQ ID NO: 1038 - protein, 29 aa, Artificial Sequence
  Core polypeptide
GDEFDASISQTNEKTNQSLAFTRKSDELT

SEQ ID NO: 1039 - protein, 29 aa, Artificial Sequence
  Core polypeptide
GDEFDASTSQTNEKTNQSLAFTRKSDELT

SEQ ID NO: 1040 - protein, 29 aa, Artificial Sequence
  Core polypeptide
GDEYDASTSQTNEKTNQSLAFTRKSDELT

SEQ ID NO: 1041 - protein, 29 aa, Artificial Sequence
  Core polypeptide
GDEFDEEISQVNEKIEESLAFIRKSDELL

SEQ ID NO: 1042 - protein, 29 aa, Artificial Sequence
  Core polypeptide
GDEFDASISQVNEKINQSLAFIRKSDELA

SEQ ID NO: 1043 - protein, 29 aa, Artificial Sequence
  Core polypeptide
GDEFDASASQANEKANQSLAFARKSDELA

SEQ ID NO: 1044 - protein, 29 aa, Artificial Sequence
  Core polypeptide
GDEFDESISQVNEKIEESLAFTRKSDELL

SEQ ID NO: 1045 - protein, 29 aa, Artificial Sequence
  Core polypeptide
GDEFDESISQVNEKTEESLAFIRKSDELL

SEQ ID NO: 1046 - protein, 29 aa, Artificial Sequence
  Core polypeptide
GDEFDESISQTNEKIEESLAFIRKSDELL

SEQ ID NO: 1047 - protein, 29 aa, Artificial Sequence
  Core polypeptide
GDEFDESTSQVNEKIEESLAFIRKSDELL

SEQ ID NO: 1048 - protein, 36 aa, Artificial Sequence
  Core polypeptide
WNWFDEFDESTSQVNEKIEESLAFIRKSDELLWNWF

SEQ ID NO: 1049 - protein, 36 aa, Artificial Sequence
  Core polypeptide
WNWFDEFDESTSQTNEKIEESLAFIRKSDELLWNWF

SEQ ID NO: 1050 - protein, 36 aa, Artificial Sequence
  Core polypeptide
WNWFDEFDESTSQTNEKTEESLAFIRKSDELLWNWF

SEQ ID NO: 1051 - protein, 36 aa, Artificial Sequence
  Core polypeptide
YTNLIYTLLEESQNQQEKNEQELLELDKWASLWSWF

SEQ ID NO: 1052 - protein, 46 aa, Artificial Sequence
  Core polypeptide
WQEWEQKVRYLEANITALLEQAQIQQEKNEYELQKLDKWASLWNWF

SEQ ID NO: 1053 - protein, 50 aa, Artificial Sequence
  Core polypeptide
NNMTWQEWEQKVRYLEANITALLEQAQIQQEKNEYELQKLDKWASLWNWF

SEQ ID NO: 1054 - protein, 16 aa, Artificial Sequence
  Core polypeptide
WNWFIEESDELLWNWF

SEQ ID NO: 1055 - protein, 11 aa, Artificial Sequence
  Core polypeptide
GFIEESDELLW

SEQ ID NO: 1056 - protein, 11 aa, Artificial Sequence
  Core polypeptide
WFIEESDELLW

SEQ ID NO: 1057 - protein, 17 aa, Artificial Sequence
  Core polypeptide
GFNFFIEESDELLFNFF

SEQ ID NO: 1058 - protein, 7 aa, Artificial Sequence
  Core polypeptide
GESDELW

SEQ ID NO: 1059 - protein, 39 aa, Artificial Sequence
  Core polypeptide
WNWFGDEFDESISQVQEEIEESLAFIEESDELLGGWNWF

SEQ ID NO: 1060 - protein, 48 aa, Artificial Sequence
  Core polypeptide
YTSLIHSLGGDEFDESISQVNEEIEESLAFIEESDELLGGWASLWNWF

SEQ ID NO: 1061 - protein, 29 aa, Artificial Sequence
  Core polypeptide
GDEFDESISQVQEEIEESLAFIEESDELL

SEQ ID NO: 1062 - protein, 53 aa, Artificial Sequence
  Core polypeptide
HQARQLLSSIMQQQNNLLRAIEAQQHLLQLTVWGIKQLQARILAVERYLKDQH

SEQ ID NO: 1063 - protein, 25 aa, Artificial Sequence
  Core polypeptide
CPKYVKQNTLKLATGMRNVPEKQTR

SEQ ID NO: 1064 - protein, 30 aa, Artificial Sequence
  Core polypeptide
GLFGAIAGFIENGWEGMIDGWYGFRHQNSC

SEQ ID NO: 1065 - protein, 7 aa, Artificial Sequence
  Core polypeptide
LNFLGGT

SEQ ID NO: 1066 - protein, 14 aa, Artificial Sequence
  Core polypeptide
LDSWWTSLNFLGGT

SEQ ID NO: 1067 - protein, 21 aa, Artificial Sequence
  Core polypeptide
ILTIPQSLDSWWTSLNFLGGT

SEQ ID NO: 1068 - protein, 28 aa, Artificial Sequence
  Core polypeptide
GFFLLTRILTIPQSLDSWWTSLNFLGGT

SEQ ID NO: 1069 - protein, 39 aa, Artificial Sequence
  Core polypeptide
WQEWEQKITALLEQAQIQQEKNEYELQKLDKWASLWNWF

SEQ ID NO: 1070 - protein, 36 aa, Artificial Sequence
  Core polypeptide
WNWFITALLEQAQIQQEKNEYELQKLDKWASLWNWF

SEQ ID NO: 1071 - protein, 39 aa, Artificial Sequence
  Core polypeptide
WQEWEQKITALLEQAQIQQEKNEYELQKLDKWASLWEWF

SEQ ID NO: 1072 - protein, 36 aa, Artificial Sequence
  Core polypeptide
WQEWEQKVRYLEANITALLEQAQIQQEKIEYELQKL

SEQ ID NO: 1073 - protein, 36 aa, Artificial Sequence
  Core polypeptide
WQEWEQKVRYLEAQITALLEQAQIQQEKIEYELQKL

SEQ ID NO: 1074 - protein, 35 aa, Artificial Sequence
  Core polypeptide
KENKANGTDAKVKLIKQELDKYKNAVTELQLLMQS

SEQ ID NO: 1075 - protein, 35 aa, Artificial Sequence
  Core polypeptide
NIKENKANGTDAKVKLIKQELDKYKNAVTELQLLM

SEQ ID NO: 1076 - protein, 36 aa, Artificial Sequence; identical to SEQ ID NO: 15
  Core polypeptide

SEQ ID NO: 1077 - protein, 37 aa, Artificial Sequence
  Core polypeptide
GWNWFDEFDESISQVQEEIEESLAFIEESDELLWNWF

SEQ ID NO: 1078 - protein, 38 aa, Artificial Sequence
  Core polypeptide
WNWFGDEFDESISQVNEKIEESLAFIEESDELLGWNWF

SEQ ID NO: 1079 - protein, 38 aa, Artificial Sequence
  Core polypeptide
WNWFGDEFDESISQVNEKIEESLAFIRKSDELLGWNWF

SEQ ID NO: 1080 - protein, 36 aa, Artificial Sequence; identical to SEQ ID NO: 1001
  Core polypeptide

SEQ ID NO: 1081 - protein, 36 aa, Artificial Sequence
  Core polypeptide
WNWFDEFDESISQVNEKIEESLAFIEESDELLWNWF

SEQ ID NO: 1082 - protein, 21 aa, Artificial Sequence
  Core polypeptide
EESQNQQEKNEQELLELDKWA

SEQ ID NO: 1083 - protein, 21 aa, Artificial Sequence
  Core polypeptide
EESQNQQEKNEQELLELDKWA

SEQ ID NO: 1084 - protein, 36 aa, Artificial Sequence
  Core polypeptide
CGTTDRSGAPTYSWGANDTDVFVLNNTRPPLGNWFG

SEQ ID NO: 1085 - protein, 28 aa, Artificial Sequence
  Core polypeptide
GVEHRLEANWTRGERADLEDRDRSELSP

SEQ ID NO: 1086 - protein, 27 aa, Artificial Sequence
  Core polypeptide
CVREGNASRAWVAVTPTVATRDGKLPT

SEQ ID NO: 1087 - protein, 20 aa, Artificial Sequence
  Core polypeptide
CFSPRHHWTTQDANASIYPG

SEQ ID NO: 1088 - protein, 33 aa, Artificial Sequence
  Core polypeptide
LQHYREVAAAKSSENDRLRLLLKQMCPSLDVDS

SEQ ID NO: 1089 - protein, 46 aa, Artificial Sequence
  Core polypeptide
WQEWDREISNYTSLITALLEQAQIQQEKNEYELQKLDEWASLWEWF

SEQ ID NO: 1090 - protein, 48 aa, Artificial Sequence
  Core polypeptide
CWQEWDREISNYTSLITALLEQAQIQQEKNEYELQKLDEWASLWEWFC

SEQ ID NO: 1091 - protein, 42 aa, Artificial Sequence
  Core polypeptide
WQEWDREISNYTSLITALLEQAQIQQEKNEYELQKLDEWEWF

SEQ ID NO: 1092 - protein, 44 aa, Artificial Sequence
  Core polypeptide
CWQEWDREISNYTSLITALLEQAQIQQEKNEYELQKLDEWEWFC

SEQ ID NO: 1093 - protein, 26 aa, Artificial Sequence
  Core polypeptide
GQNSQSPTSNHSPTSAPPTAPGYRWA

SEQ ID NO: 1094 - protein, 27 aa, Artificial Sequence
  Core polypeptide
PGSSTTSTGPARTALTTAQGTSLYPSA

SEQ ID NO: 1095 - protein, 39 aa, Artificial Sequence
  Core polypeptide
PGSSTTSTGPARTALTTAQGTSLYPSAAATKPSDGNATA

SEQ ID NO: 1096 - protein, 16 aa, Artificial Sequence
  Core polypeptide
QKQEPIDKELYPLTSL

SEQ ID NO: 1097 - protein, 39 aa, Artificial Sequence
  Core polypeptide
WQEWDREITALLEQAQIQQEKNEYELQKLDKWASLWNWF

SEQ ID NO: 1098 - protein, 39 aa, Artificial Sequence
  Core polypeptide
WQEWDREITALLEQAQIQQEKNEYELQKLDEWASLWEWF

SEQ ID NO: 1099 - protein, 35 aa, Artificial Sequence
  Core polypeptide
WQEWDREITALLEQAQIQQEKNEYELQKLDEWEWF

SEQ ID NO: 1100 - protein, 35 aa, Artificial Sequence
  Core polypeptide
WQEWEREITALLEQAQIQQEKIEYELQKLIEWEWF

SEQ ID NO: 1101 - protein, 35 aa, Artificial Sequence
  Core polypeptide
WQEWEREITALLEQAQIQQEKNEYELQKLIEWEWF

SEQ ID NO: 1102 - protein, 35 aa, Artificial Sequence
  Core polypeptide
WQEWEREITALLEQAQIQQEKIEYELQKLDEWEWF

SEQ ID NO: 1103 - protein, 33 aa, Artificial Sequence
  Core polypeptide
WQEWEITALLEQAQIQQEKNEYELQKLDEWEWF

SEQ ID NO: 1104 - protein, 33 aa, Artificial Sequence
  Core polypeptide
WQEWEITALLEQAQIQQEKNEYELQKLIEWEWF

SEQ ID NO: 1105 - protein, 33 aa, Artificial Sequence
  Core polypeptide
WQEWEITALLEQAQIQQEKIEYELQKLDEWEWF

SEQ ID NO: 1106 - protein, 33 aa, Artificial Sequence
  Core polypeptide
WQEWEITALLEQAQIQQEKIEYELQKLIEWEWF

SEQ ID NO: 1107 - protein, 39 aa, Artificial Sequence
  Core polypeptide
WQEWDREIDEYDASISQVNEKINQALAYIREADELWEWF

SEQ ID NO: 1108 - protein, 39 aa, Artificial Sequence
  Core polypeptide
WQEWEREIDEYDASISQVNEKINQALAYIREADELWEWF

SEQ ID NO: 1109 - protein, 37 aa, Artificial Sequence
  Core polypeptide
WQEWEIDEYDASISQVNEKINQALAYIREADELWEWF

SEQ ID NO: 1110 - protein, 39 aa, Artificial Sequence
  Core polypeptide
WQEWDREIDEYDASISQVNEEINQALAYIREADELWEWF

SEQ ID NO: 1111 - protein, 39 aa, Artificial Sequence
  Core polypeptide
WQEWEREIDEYDASISQVNEEINQALAYIREADELWEWF

SEQ ID NO: 1112 - protein, 37 aa, Artificial Sequence
  Core polypeptide
WQEWEIDEYDASISQVNEEINQALAYIREADELWEWF

SEQ ID NO: 1113 - protein, 35 aa, Artificial Sequence
  Core polypeptide
WQEWDEYDASISQVNEKINQALAYIREADELWEWF

SEQ ID NO: 1114 - protein, 35 aa, Artificial Sequence
  Core polypeptide
WQEWDEYDASISQVNEEINQALAYIREADELWEWF

SEQ ID NO: 1115 - protein, 35 aa, Artificial Sequence
  Core polypeptide
WQEWEQKITALLEQAQIQQEKIEYELQKLIEWEWF

SEQ ID NO: 1116 - protein, 39 aa, Artificial Sequence
  Core polypeptide
WQEWEQKITALLEQAQIQQEKIEYELQKLIEWASLWEWF

SEQ ID NO: 1117 - protein, 37 aa, Artificial Sequence
  Core polypeptide
WQEWEITALLEQAQIQQEKIEYELQKLIEWASLWEWF

SEQ ID NO: 1118 - protein, 44 aa, Artificial Sequence
  Core polypeptide
NHTTWMEWDREINNYTSLIHSLIEESQNQQEKNEQELLELDKWH

SEQ ID NO: 1119 - protein, 52 aa, Artificial Sequence
  Core polypeptide
QARQLLSGIVQQQNNLLRAIEAQQHLLQLTVWGIKQLQARILAVERYLKDQH

SEQ ID NO: 1120 - protein, 40 aa, Artificial Sequence
  Core polypeptide
WVYPSDEYDASISQVNEEINQALAYIRKADELLENVWNWF

SEQ ID NO: 1121 - protein, 36 aa, Artificial Sequence; identical to SEQ ID NO: 15
  Core polypeptide

SEQ ID NO: 1122 - protein, 35 aa, Artificial Sequence
  Core polypeptide
WQEWDEYDASISQVNEKINQALAYIREADELWAWF

SEQ ID NO: 1123 - protein, 35 aa, Artificial Sequence
  Core polypeptide
WQAWDEYDASISQVNEKINQALAYIREADELWAWF

SEQ ID NO: 1124 - protein, 35 aa, Artificial Sequence
  Core polypeptide
WQAWDEYDASISQVNEKINQALAYIREADELWEWF

SEQ ID NO: 1125 - protein, 35 aa, Artificial Sequence; identical to SEQ ID NO: 104
  Core polypeptide

SEQ ID NO: 1126 - protein, 28 aa, Artificial Sequence
  Core polypeptide
YDPLVFPSDEFDASISQVNEKINQSLAF

SEQ ID NO: 1127 - protein, 29 aa, Artificial Sequence
  Core polypeptide
QVNEKINQSLAFIRKSDELLHNVNAGKST

SEQ ID NO: 1128 - protein, 8 aa, Artificial Sequence
  Core polypeptide
WMEWDREI

SEQ ID NO: 1129 - protein, 8 aa, Artificial Sequence
  Core polypeptide
WQEWEQKI

SEQ ID NO: 1130 - protein, 39 aa, Artificial Sequence
  Core polypeptide
WQEWEQKITALLEQAQIQQEKIEYELQKLIKWASLWEWF

SEQ ID NO: 1131 - protein, 39 aa, Artificial Sequence; identical to SEQ ID NO: 1116
  Core polypeptide

SEQ ID NO: 1132 - protein, 42 aa, Artificial Sequence
  Core polypeptide
WQEWEREISAYTSLITALLEQAQIQQEKIEYELQKLIEWEWF

SEQ ID NO: 1133 - protein, 40 aa, Artificial Sequence
  Core polypeptide
WQEWEREISAYTSLITALLEQAQIQQEKIEYELQKEWEWF

SEQ ID NO: 1134 - protein, 39 aa, Artificial Sequence
  Core polypeptide
WQEWEREISAYTSLITALLEQAQIQQEKIEYELQKEWEW

SEQ ID NO: 1135 - protein, 41 aa, Artificial Sequence
  Core polypeptide
WQEWEREISAYTSLITALLEQAQIQQEKIEYELQKLIEWEW

SEQ ID NO: 1136 - protein, 36 aa, Artificial Sequence
  Core polypeptide
FNLSDHSESIQKKFQLMKKHVNKIGVDSDPIGSWLR

SEQ ID NO: 1137 - protein, 35 aa, Artificial Sequence
  Core polypeptide
DHSESIQKKFQLMKKHVNKIGVDSDPIGSWLRGIF

SEQ ID NO: 1138 - protein, 40 aa, Artificial Sequence
  Core polypeptide
WSVKQANLTTSLLGDLLDDVTSIRHAVLQNRAWMEWDREI

SEQ ID NO: 1139 - protein, 18 aa, Artificial Sequence
  Core polypeptide
NNMTWMEWDREINNYTSL

SEQ ID NO: 1140 - protein, 36 aa, Artificial Sequence
  Core polypeptide
GAASLTLTVQARQLLSGIVQQQNNLLRAIEAQQHLL

SEQ ID NO: 1141 - protein, 36 aa, Artificial Sequence
  Core polypeptide
ASLTLTVQARQLLSGIVQQQNNLLRAIEAQQHLLQL

SEQ ID NO: 1142 - protein, 34 aa, Artificial Sequence
  Core polypeptide
VSVGNTLYYVNKQEGKSLYVKGEPIINFYDPLVF

SEQ ID NO: 1143 - protein, 10 aa, Artificial Sequence
  Core polypeptide
QHWSYGLRPG

SEQ ID NO: 1144 - protein, 26 aa, Artificial Sequence
  Core polypeptide
WQEWEQKIQHWSYGLRPGWASLWEWF

SEQ ID NO: 1145 - protein, 22 aa, Artificial Sequence
  Core polypeptide
WQEWEQKIQHWSYGLRPGWEWF

SEQ ID NO: 1146 - protein, 18 aa, Artificial Sequence
  Core polypeptide
WNWFQHWSYGLRPGWNWF

SEQ ID NO: 1147 - protein, 18 aa, Artificial Sequence
  Core polypeptide
FNFFQHWSYGLRPGFNFF

SEQ ID NO: 1148 - protein, 18 aa, Artificial Sequence
  Core polypeptide
GAGAQHWSYGLRPGAGAG

SEQ ID NO: 1149 - protein, 39 aa, Artificial Sequence
  Core polypeptide
WQEWEQKITALLEQAQIQQEKIEYELQKLAKWASLWEWF

SEQ ID NO: 1150 - protein, 39 aa, Artificial Sequence
  Core polypeptide
WQEWEQKITALLEQAQIQQEKIEYELQKLAEWASLWEWF

SEQ ID NO: 1151 - protein, 39 aa, Artificial Sequence
  Core polypeptide
WQEWEQKITALLEQAQIQQEKAEYELQKLAEWASLWEWF

SEQ ID NO: 1152 - protein, 39 aa, Artificial Sequence
  Core polypeptide
WQEWEQKITALLEQAQIQQEKAEYELQKLAEWASLWAWF

SEQ ID NO: 1153 - protein, 39 aa, Artificial Sequence
  Core polypeptide
WQEWEQKITALLEQAQIQQEKAEYELQKLAKWASLWAWF

SEQ ID NO: 1154 - protein, 36 aa, Artificial Sequence
  Core polypeptide
TNKAVVSLSNGVSVLTSKVLDLKNYIDKQLLPIVNK

SEQ ID NO: 1155 - protein, 36 aa, Artificial Sequence
  Core polypeptide
KAVVSLSNGVSVLTSKVLDLKNYIDKQLLPIVNKQS

SEQ ID NO: 1156 - protein, 35 aa, Artificial Sequence
  Core polypeptide
WQEWEQKITALLEQAQIQQEKNEYELQKLIEWEWF

SEQ ID NO: 1157 - protein, 35 aa, Artificial Sequence
  Core polypeptide
WQEWEQKITALLEQAQIQQEKGEYELQKLIEWEWF

SEQ ID NO: 1158 - protein, 35 aa, Artificial Sequence
  Core polypeptide
WQEWEQKITALLEQAQIQQEKIEYELQKLDKWEWF

SEQ ID NO: 1159 - protein, 28 aa, Artificial Sequence
  Core polypeptide
YDPLVFPSDEFDASISQVNEKINQSLAF

SEQ ID NO: 1160 - protein, 35 aa, Artificial Sequence; identical to SEQ ID NO: 692
  Core polypeptide

SEQ ID NO: 1161 - protein, 36 aa, Artificial Sequence; identical to SEQ ID NO: 15
  Core polypeptide

SEQ ID NO: 1162 - protein, 36 aa, Artificial Sequence
  Core polypeptide
SGIVQQQNNLLRAIEAQQHLLQLTVWGIKQLQARIL

SEQ ID NO: 1163 - protein, 41 aa, Artificial Sequence
  Core polypeptide
QQQNNLLRAIEAQQHLLQLTVWGIKQLQARILAVERYLKDQ

SEQ ID NO: 1164 - protein, 45 aa, Artificial Sequence
  Core polypeptide
SGIVQQQNNLLRAIEAQQHLLQLTVWGIKQLQARILAVERYLKDQ

SEQ ID NO: 1165 - protein, 39 aa, Artificial Sequence
  Core polypeptide
WQEWEQKITALLEQAQIQQEKNEYELQKLAEWASLWAWF

SEQ ID NO: 1166 - protein, 38 aa, Artificial Sequence
  Core polypeptide
WQEWEQKITALLEQAQIQQEKNEYELQKLAEWASLWAW

SEQ ID NO: 1167 - protein, 38 aa, Artificial Sequence
  Core polypeptide
WQEWEQKITALLEQAQIQQEKAEYELQKLAEWASLWAW

SEQ ID NO: 1168 - protein, 39 aa, Artificial Sequence
  Core polypeptide
WQEWEQKITALLEQAQIQQEKNEYELQKLAEWAGLWAWF

SEQ ID NO: 1169 - protein, 38 aa, Artificial Sequence
  Core polypeptide
WQEWEQKITALLEQAQIQQEKNEYELQKLAEWAGLWAW

SEQ ID NO: 1170 - protein, 38 aa, Artificial Sequence
  Core polypeptide
WQEWEQKITALLEQAQIQQEKAEYELQKLAEWAGLWAW

SEQ ID NO: 1171 - protein, 39 aa, Artificial Sequence
  Core polypeptide
WQEWEQKITALLEQAQIQQEKNEYELQKLDKWAGLWEWF

SEQ ID NO: 1172 - protein, 18 aa, Artificial Sequence
  Core polypeptide
WQEWQHWSYGLRPGWEWF

SEQ ID NO: 1173 - protein, 18 aa, Artificial Sequence
  Core polypeptide
WQAWQHWSYGLRPGWAWF

SEQ ID NO: 1174 - protein, 39 aa, Artificial Sequence; identical to SEQ ID NO: 1071
  Core polypeptide

SEQ ID NO: 1175 - protein, 39 aa, Artificial Sequence; identical to SEQ ID NO: 1071
  Core polypeptide

SEQ ID NO: 1176 - protein, 35 aa, Artificial Sequence; identical to SEQ ID NO: 1115
  Core polypeptide

SEQ ID NO: 1177 - protein, 34 aa, Artificial Sequence
  Core polypeptide
WQEWEQKIALLEQAQIQQEKIEYELQKLIEWEWF

SEQ ID NO: 1178 - protein, 38 aa, Artificial Sequence
  Core polypeptide
WQEWEQKIALLEQAQIQQEKNEYELQKLDKWASLWEWF

SEQ ID NO: 1179 - protein, 38 aa, Artificial Sequence
  Core polypeptide
AGSTMGARSMTLTVQARQLLSGIVQQQNNLLRAIEAQQ

SEQ ID NO: 1180 - protein, 38 aa, Artificial Sequence
  Core polypeptide
AGSAMGAASLTLSAQSRTLLAGIVQQQQQLLDVVKRQQ

SEQ ID NO: 1181 - protein, 38 aa, Artificial Sequence
  Core polypeptide
AGSAMGAASTALTAQSRTLLAGIVQQQQQLLDVVKRQQ

SEQ ID NO: 1182 - protein, 38 aa, Artificial Sequence
  Core polypeptide
ALTAQSRTLLAGIVQQQQQLLDVVKRQQELLRLTVWGT

SEQ ID NO: 1183 - protein, 38 aa, Artificial Sequence
  Core polypeptide
TLSAQSRTLLAGIVQQQQQLLDVVKRQQEMLRLTVWGT

SEQ ID NO: 1184 - protein, 38 aa, Artificial Sequence
  Core polypeptide
TLTVQARQLLSGIVQQQNNLLRAIEAQQHLLQLTVWGI

SEQ ID NO: 1185 - protein, 35 aa, Artificial Sequence
  Core polypeptide
WQAWIEYEAELSQVKEKIEQSLAYIREADELWAWF

SEQ ID NO: 1186 - protein, 35 aa, Artificial Sequence
  Core polypeptide
WQAWIEYEASLSQAKEKIEESKAYIREADELWAWF

SEQ ID NO: 1187 - protein, 35 aa, Artificial Sequence
  Core polypeptide
WQAWIEYERLLVQAKLKIAIAKLYIAKELLEWAWF

SEQ ID NO: 1188 - protein, 35 aa, Artificial Sequence
  Core polypeptide
WQAWIEYERLLVQVKLKIAIALLYIAKELLEWAWF

SEQ ID NO: 1189 - protein, 35 aa, Artificial Sequence
  Core polypeptide
WQAWIELERLLVQVKLKLAIAKLEIAKELLEWAWF

SEQ ID NO: 1190 - protein, 19 aa, Artificial Sequence
  Core polypeptide
GEWTYDDATKTFTVTEGGH

SEQ ID NO: 1191 - protein, 35 aa, Artificial Sequence
  Core polypeptide
WQEWEQKIGEWTYDDATKTFTVTEGGHWASLWEWF

SEQ ID NO: 1192 - protein, 16 aa, Artificial Sequence
  Core polypeptide
GEWTYDDATKTFTVTE

SEQ ID NO: 1193 - protein, 32 aa, Artificial Sequence
  Core polypeptide
WQEWEQKIGEWTYDDATKTFTVTEWASLWEWF

SEQ ID NO: 1194 - protein, 8 aa, Artificial Sequence
  Core polypeptide
MHRFDYRT

SEQ ID NO: 1195 - protein, 24 aa, Artificial Sequence
  Core polypeptide
WQEWEQKIMHRFDYRTWASLWEWF

SEQ ID NO: 1196 - protein, 11 aa, Artificial Sequence
  Core polypeptide
MHRFNWSTGGG

SEQ ID NO: 1197 - protein, 27 aa, Artificial Sequence
  Core polypeptide
WQEWEQKIMHRFNWSTGGGWASLWEWF

SEQ ID NO: 1198 - protein, 8 aa, Artificial Sequence
  Core polypeptide
MHRFNWST

SEQ ID NO: 1199 - protein, 24 aa, Artificial Sequence
  Core polypeptide
WQEWEQKIMHRFNWSTWASLWEWF

SEQ ID NO: 1200 - protein, 18 aa, Artificial Sequence
  Core polypeptide
LLVPLARIMTMSSVHGGG

SEQ ID NO: 1201 - protein, 34 aa, Artificial Sequence
  Core polypeptide
WQEWEQKILLVPLARIMTMSSVHGGGWASLWEWF

SEQ ID NO: 1202 - protein, 15 aa, Artificial Sequence
  Core polypeptide
LLVPLARIMTMSSVH

SEQ ID NO: 1203 - protein, 31 aa, Artificial Sequence
  Core polypeptide
WQEWEQKILLVPLARIMTMSSVHWASLWEWF

SEQ ID NO: 1204 - protein, 23 aa, Artificial Sequence
  Core polypeptide
TALLEQAQIQQEKNEYELQKLDK

SEQ ID NO: 1205 - protein, 23 aa, Artificial Sequence
  Core polypeptide
TALLEQAQIQQEKNEYELQKLDK

SEQ ID NO: 1206 - protein, 23 aa, Artificial Sequence
  Core polypeptide
TALLEQAQIQQEKIEYELQKLIE

SEQ ID NO: 1207 - protein, 23 aa, Artificial Sequence
  Core polypeptide
TALLEQAQIQQEKIEYELQKLIE

SEQ ID NO: 1208 - protein, 47 aa, Artificial Sequence
  Core polypeptide
QARQLLSGIVQQQNNLLRAIEAQQHLLQLTVWGIKQLQARILAVERY

SEQ ID NO: 1209 - protein, 47 aa, Artificial Sequence; identical to SEQ ID NO: 1208
  Core polypeptide

SEQ ID NO: 1210 - protein, 36 aa, Artificial Sequence
  Core polypeptide
GAASLTLSAQSRTLLAGIVQQQQQLLDVVKRQQEML

SEQ ID NO: 1211 - protein, 40 aa, Artificial Sequence
  Core polypeptide
GSAMGAASLTLSAQSRTLLAGIVQQQQQLLDVVKRQQEML

SEQ ID NO: 1212 - protein, 36 aa, Artificial Sequence
  Core polypeptide
PALSTGLIHLHQNIVDVQFLFGVGSSIASWAIKWEY

SEQ ID NO: 1213 - protein, 33 aa, Artificial Sequence
  Core polypeptide
PALSTGLIHLHQNIVDVQFLYGVGSSIASWAIK

SEQ ID NO: 1214 - protein, 34 aa, Artificial Sequence
  Core polypeptide
LSTTQWQVLPSFTTLPALSTGLIHLHQNIVDVQY

SEQ ID NO: 1215 - protein, 31 aa, Artificial Sequence
  Core polypeptide
FRKFPEATFSRGSGPRITPRMVDFPFRLWHY

SEQ ID NO: 1216 - protein, 37 aa, Artificial Sequence
  Core polypeptide
DFPFRLWHFPTINYTIFKVRLFVGGVEHRLEAANWTR

SEQ ID NO: 1217 - protein, 32 aa, Artificial Sequence
  Core polypeptide
YVGGVEHRLEAANWTRGERDLEDRDRSELSPL

SEQ ID NO: 1218 - protein, 36 aa, Artificial Sequence
  Core polypeptide
MVYPSDEYDASISQVNEEINQALAYIRKADELLENV

SEQ ID NO: 1219 - protein, 36 aa, Artificial Sequence; identical to SEQ ID NO: 1218
  Core polypeptide

SEQ ID NO: 1220 - protein, 35 aa, Artificial Sequence
  Core polypeptide
GPLLVLQAGFFLLTRILTIPQSLDSWWTSLNFLGG

SEQ ID NO: 1221 - protein, 35 aa, Artificial Sequence
  Core polypeptide
LGPLLVLQAGFFLLTRILTIPQSLDSWWTSLNFLG

SEQ ID NO: 1222 - protein, 35 aa, Artificial Sequence
  Core polypeptide
FLGPLLVLQAGFFLLTRILTIPQSLDSWWTSLNFL

SEQ ID NO: 1223 - protein, 36 aa, Artificial Sequence
  Core polypeptide
YTSLIGSLIEESQIQQERNEQELLELDRWASLWEWF

SEQ ID NO: 1224 - protein, 34 aa, Artificial Sequence
  Core polypeptide
VYPSDEYDASISQVNEEINQALAYIRKADELLEH

SEQ ID NO: 1225 - protein, 33 aa, Artificial Sequence
  Core polypeptide
VYPSDEYDASISQVNEEINQALAYIRKADELLH

SEQ ID NO: 1226 - protein, 32 aa, Artificial Sequence
  Core polypeptide
VYPSDEYDASISQVNEEINQALAYIRKADELH

SEQ ID NO: 1227 - protein, 34 aa, Artificial Sequence
  Core polypeptide
YPSDEYDASISQVNEEINQALAYIRKADELLENV

SEQ ID NO: 1228 - protein, 33 aa, Artificial Sequence
  Core polypeptide
PSDEYDASISQVNEEINQALAYIRKADELLENV

SEQ ID NO: 1229 - protein, 32 aa, Artificial Sequence
  Core polypeptide
SDEYDASISQVNEEINQALAYIRKADELLENV

SEQ ID NO: 1230 - protein, 31 aa, Artificial Sequence
  Core polypeptide
DEYDASISQVNEEINQALAYIRKADELLENV

SEQ ID NO: 1231 - protein, 35 aa, Artificial Sequence
  Core polypeptide
VYPSDEYDASISQVDEEINQALAYIRKADELLENV

SEQ ID NO: 1232 - protein, 35 aa, Artificial Sequence
  Core polypeptide
VYPSDEYDASISQVNEEIDQALAYIRKADELLENV

SEQ ID NO: 1233 - protein, 35 aa, Artificial Sequence
  Core polypeptide
VYPSDEYDASISQVNEEINQALAYIRKADELLEDV

SEQ ID NO: 1234 - protein, 35 aa, Artificial Sequence
  Core polypeptide
VYPSDEYDASISQVDEEIDQALAYIRKADELLENV

SEQ ID NO: 1235 - protein, 35 aa, Artificial Sequence
  Core polypeptide
LLSTNKAVVSLSNGVSVLTSKVLDLKNYIDKQLLP

SEQ ID NO: 1236 - protein, 35 aa, Artificial Sequence
  Core polypeptide
LSTNKAVVSLSNGVSVLTSKVLDLKNYIDKQLLPI

SEQ ID NO: 1237 - protein, 35 aa, Artificial Sequence; identical to SEQ ID NO: 692
  Core polypeptide

SEQ ID NO: 1238 - protein, 27 aa, Artificial Sequence
  Core polypeptide
DEYDASISQVNEEINQALAYIREADEL

SEQ ID NO: 1239 - protein, 27 aa, Artificial Sequence
  Core polypeptide
DEYDASISQVNEKINQALAYIREADEL

SEQ ID NO: 1240 - protein, 35 aa, Artificial Sequence
  Core polypeptide
DDECLNSVKNGTYDFPKFEEESKLNRNEIKGVKLS

SEQ ID NO: 1241 - protein, 36 aa, Artificial Sequence
  Core polypeptide
DDEABLNSVKNGTYDFPKFEEESKLNRNEIKGVKLS

SEQ ID NO: 1242 - protein, 40 aa, Artificial Sequence
  Core polypeptide
YHKCDDECLNSVKNGTFDFPKFEEESKLNRNEIKGVKLSS

SEQ ID NO: 1243 - protein, 42 aa, Artificial Sequence
  Core polypeptide
YHKABDDEABLNSVKNGTFDFPKFEEESKLNRNEIKGVKLSS

SEQ ID NO: 1244 - protein, 36 aa, Artificial Sequence
  Core polypeptide
YTSLIHSLIEESQIQQEKNEYELQKLDKWASLWNWF

SEQ ID NO: 1245 - protein, 36 aa, Artificial Sequence
  Core polypeptide
YTSLIHSLIEESQNQQEKNEQELQKLDKWASLWNWF

SEQ ID NO: 1246 - protein, 36 aa, Artificial Sequence
  Core polypeptide
YTSLIHSLIEESQNQQEKNEYELQKLDKWASLWNWF

SEQ ID NO: 1247 - protein, 36 aa, Artificial Sequence
  Core polypeptide
YTSLIHSLIEESQIQQEKNEQELQKLDKWASLWNWF

SEQ ID NO: 1248 - protein, 36 aa, Artificial Sequence
  Core polypeptide
YTSLIHSLIEESQNQQEKNEQELLELDKWASLWEWF

SEQ ID NO: 1249 - protein, 36 aa, Artificial Sequence
  Core polypeptide
YTSLIHSLIEESQIQQEKNEQELLELDKWASLWEWF

SEQ ID NO: 1250 - protein, 36 aa, Artificial Sequence
  Core polypeptide
YTSLIHSLIEESQNQQEKNEYELLELDKWASLWEWF

SEQ ID NO: 1251 - protein, 36 aa, Artificial Sequence
  Core polypeptide
YTSLIHSLIEESQIQQEKNEYELLELDKWASLWEWF

SEQ ID NO: 1252 - protein, 36 aa, Artificial Sequence
  Core polypeptide
YTSLIHSLIEESQIQQEKNEYELQKLDKWASLWEWF

SEQ ID NO: 1253 - protein, 36 aa, Artificial Sequence
  Core polypeptide
YTSLIHSLIEESQNQQEKNEQELQKLDKWASLWEWF

SEQ ID NO: 1254 - protein, 36 aa, Artificial Sequence
  Core polypeptide
YTSLIHSLIEESQNQQEKNEYELQKLDKWASLWEWF

SEQ ID NO: 1255 - protein, 36 aa, Artificial Sequence
  Core polypeptide
YTSLIHSLIEESQIQQEKNEQELQKLDKWASLWEWF

SEQ ID NO: 1256 - protein, 39 aa, Artificial Sequence
  Core polypeptide
WQEWEQKITALLEQAQIQQEKNEYELQKLAKWASLWEWF

SEQ ID NO: 1257 - protein, 39 aa, Artificial Sequence
  Core polypeptide
WQEWEQKITALLEQAQIQQEKNEYELQKLIKWASLWEWF

SEQ ID NO: 1258 - protein, 39 aa, Artificial Sequence
  Core polypeptide
WQEWEQKITALLEQAQIQQEKNEYELQKLIEWAGLWEWF

SEQ ID NO: 1259 - protein, 39 aa, Artificial Sequence
  Core polypeptide
WQEWEQKITALLEQAQIQQEKNEYELQKLIKWAGLWEWF

SEQ ID NO: 1260 - protein, 39 aa, Artificial Sequence
  Core polypeptide
WQEWEQKITALLEQAQIQQEKNEYELQKLAKWAGLWEWF

SEQ ID NO: 1261 - protein, 39 aa, Artificial Sequence
  Core polypeptide
WQEWEQKITALLEQAQIQQEKNEYELQKLIEWAGLWAWF

SEQ ID NO: 1262 - protein, 39 aa, Artificial Sequence
  Core polypeptide
WQEWEQKITALLEQAQIQQEKNEYELQKLAKWAGLWAWF

SEQ ID NO: 1263 - protein, 39 aa, Artificial Sequence
  Core polypeptide
WQEWEQKITALLEQAQIQQEKNEYELQKLIKWAGLWAWF

SEQ ID NO: 1264 - protein, 35 aa, Artificial Sequence
  Core polypeptide
WQEWEQKITALLEQAQIQQEKGEYELQKLDKWEWF

SEQ ID NO: 1265 - protein, 35 aa, Artificial Sequence
  Core polypeptide
WQEWEQKITALLEQAQIQQEKGEYELLELDKWEWF

SEQ ID NO: 1266 - protein, 35 aa, Artificial Sequence
  Core polypeptide
WQEWEQKITALLEQAQIQQEKGEYELQKLAKWEWF

SEQ ID NO: 1267 - protein, 35 aa, Artificial Sequence
  Core polypeptide
WQEWEQKITALLEQAQIQQEKGEYELQKLDEWEWF

SEQ ID NO: 1268 - protein, 35 aa, Artificial Sequence
  Core polypeptide
WQEWEQKITALLEQAQIQQEKGEYELLELAKWEWF

SEQ ID NO: 1269 - protein, 35 aa, Artificial Sequence
  Core polypeptide
WQEWEQKITALLEQAQIQQEKNEYELLELDKWEWF

SEQ ID NO: 1270 - protein, 39 aa, Artificial Sequence
  Core polypeptide
WQEWEQKITALLEQAQIQQEKNEYELLELIEWASLWEWF

SEQ ID NO: 1271 - protein, 39 aa, Artificial Sequence
  Core polypeptide
WQEWEQKITALLEQAQIQQEKNEYELLELIEWAGLWEWF

SEQ ID NO: 1272 - protein, 39 aa, Artificial Sequence
  Core polypeptide
WQEWEQKITALLEQAQIQQEKNEYELLELIEWAGLWAWF

SEQ ID NO: 1273 - protein, 39 aa, Artificial Sequence
  Core polypeptide
WQEWEREITALLEQAQIQQEKNEYELQKLIEWASLWEWF

SEQ ID NO: 1274 - protein, 30 aa, Artificial Sequence
  Core polypeptide
WQEWEREIQQEKNEYELQKLDKWASLWEWF

SEQ ID NO: 1275 - protein, 25 aa, Artificial Sequence
  Core polypeptide
WQEWEREIQQEKGEYELQKLEWEWF

SEQ ID NO: 1276 - protein, 29 aa, Artificial Sequence
  Core polypeptide
WQEWQAQIQQEKNEYELQKLDWASLWEWF

SEQ ID NO: 1277 - protein, 26 aa, Artificial Sequence
  Core polypeptide
WQEWQAQIQQEKGEYELQKLIEWEWF

SEQ ID NO: 1278 - protein, 28 aa, Artificial Sequence
  Core polypeptide
YTSLIHSLIEESQNQQEKNEQELLELDK

SEQ ID NO: 1279 - protein, 28 aa, Artificial Sequence
  Core polypeptide
LEENITALLEEAQIQQEKNMYELQKLNS

SEQ ID NO: 1280 - protein, 28 aa, Artificial Sequence
  Core polypeptide
LEANISQSLEQAQIQQEKNMYELQKLNS

SEQ ID NO: 1281 - protein, 28 aa, Artificial Sequence
  Core polypeptide
NNYTSLIHSLIEESQNQQEKNEQELLEL

SEQ ID NO: 1282 - protein, 28 aa, Artificial Sequence
  Core polypeptide
DFLEENITALLEEAQIQQEKNMYELQKL

SEQ ID NO: 1283 - protein, 28 aa, Artificial Sequence
  Core polypeptide
RYLEANISQSLEQAQIQQEKNMYELQKL

SEQ ID NO: 1284 - protein, 28 aa, Artificial Sequence
  Core polypeptide
RYLEANITALLEQAQIQQEKNEYELQKL

SEQ ID NO: 1285 - protein, 30 aa, Artificial Sequence
  Core polypeptide
NNYTSLIHSLIEESQNQQEKNEQELLELDK

SEQ ID NO: 1286 - protein, 23 aa, Artificial Sequence
  Core polypeptide
TALLEQAQIQQEKNEYELQKLDK

SEQ ID NO: 1287 - protein, 23 aa, Artificial Sequence
  Core polypeptide
TALLEQAQIQQEKNEYELQKLDE

SEQ ID NO: 1288 - protein, 23 aa, Artificial Sequence
  Core polypeptide
TALLEQAQIQQEKNEYELQKLIE

SEQ ID NO: 1289 - protein, 23 aa, Artificial Sequence
  Core polypeptide
TALLEQAQIQQEKIEYELQKLDK

SEQ ID NO: 1290 - protein, 23 aa, Artificial Sequence
  Core polypeptide
TALLEQAQIQQEKIEYELQKLDE

SEQ ID NO: 1291 - protein, 23 aa, Artificial Sequence
  Core polypeptide
TALLEQAQIQQEKIEYELQKLIE

SEQ ID NO: 1292 - protein, 22 aa, Artificial Sequence
  Core polypeptide
TALLEQAQIQQEKIEYELQKLE

SEQ ID NO: 1293 - protein, 23 aa, Artificial Sequence
  Core polypeptide
TALLEQAQIQQEKIEYELQKLAK

SEQ ID NO: 1294 - protein, 23 aa, Artificial Sequence
  Core polypeptide
TALLEQAQIQQEKIEYELQKLAE

SEQ ID NO: 1295 - protein, 22 aa, Artificial Sequence
  Core polypeptide
TALLEQAQIQQEKAEYELQKLE

SEQ ID NO: 1296 - protein, 22 aa, Artificial Sequence
  Core polypeptide
TALLEQAQIQQEKNEYELQKLE

SEQ ID NO: 1297 - protein, 22 aa, Artificial Sequence
  Core polypeptide
TALLEQAQIQQEKGEYELQKLE

SEQ ID NO: 1298 - protein, 23 aa, Artificial Sequence
  Core polypeptide
TALLEQAQIQQEKAEYELQKLAK

SEQ ID NO: 1299 - protein, 23 aa, Artificial Sequence
  Core polypeptide
TALLEQAQIQQEKNEYELQKLAK

SEQ ID NO: 1300 - protein, 23 aa, Artificial Sequence
  Core polypeptide
TALLEQAQIQQEKGEYELQKLAK

SEQ ID NO: 1301 - protein, 23 aa, Artificial Sequence
  Core polypeptide
TALLEQAQIQQEKAEYELQKLAE

SEQ ID NO: 1302 - protein, 23 aa, Artificial Sequence
  Core polypeptide
TALLEQAQIQQEKNEYELQKLAE

SEQ ID NO: 1303 - protein, 23 aa, Artificial Sequence
  Core polypeptide
TALLEQAQIQQEKGEYELQKLAE

SEQ ID NO: 1304 - protein, 28 aa, Artificial Sequence
  Core polypeptide
DEFDASISQVNEKINQSLAFIRKSDELL

SEQ ID NO: 1305 - protein, 27 aa, Artificial Sequence
  Core polypeptide
DEYDASISQVNEKINQALAYIREADEL

SEQ ID NO: 1306 - protein, 27 aa, Artificial Sequence
  Core polypeptide
DEYDASISQVNEEINQALAYIRKADEL

SEQ ID NO: 1307 - protein, 28 aa, Artificial Sequence
  Core polypeptide
DEFDESISQVNEKIEESLAFIRKSDELL

SEQ ID NO: 1308 - protein, 27 aa, Artificial Sequence
  Core polypeptide
DEFDESISQVNEKIEESLAFIRKSDEL

SEQ ID NO: 1309 - protein, 10 aa, Artificial Sequence
  Core polypeptide
QHWSYGLRPG

SEQ ID NO: 1310 - protein, 39 aa, Artificial Sequence; identical to SEQ ID NO: 1071
  Core polypeptide

SEQ ID NO: 1311 - protein, 35 aa, Artificial Sequence; identical to SEQ ID NO: 1115
  Core polypeptide

SEQ ID NO: 1312 - protein, 35 aa, Artificial Sequence; identical to SEQ ID NO: 692
  Core polypeptide

SEQ ID NO: 1313 - protein, 28 aa, Artificial Sequence
  Core polypeptide
YTSLIHSLIEESQNQQEKNEQELLELDK

SEQ ID NO: 1314 - protein, 28 aa, Artificial Sequence
  Core polypeptide
LEENITALLEEAQIQQEKNMYELQKLNS

SEQ ID NO: 1315 - protein, 28 aa, Artificial Sequence
  Core polypeptide
LEANISQSLEQAQIQQEKNMYELQKLNS

SEQ ID NO: 1316 - protein, 28 aa, Artificial Sequence
  Core polypeptide
NNYTSLIHSLIEESQNQQEKNEQELLEL

SEQ ID NO: 1317 - protein, 28 aa, Artificial Sequence
  Core polypeptide
DFLEENITALLEEAQIQQEKNMYELQKL

SEQ ID NO: 1318 - protein, 28 aa, Artificial Sequence
  Core polypeptide
RYLEANISQSLEQAQIQQEKNMYELQKL

SEQ ID NO: 1319 - protein, 28 aa, Artificial Sequence
  Core polypeptide
RYLEANITALLEQAQIQQEKNEYELQKL

SEQ ID NO: 1320 - protein, 30 aa, Artificial Sequence; identical to SEQ ID NO: 1285
  Core polypeptide

SEQ ID NO: 1321 - protein, 23 aa, Artificial Sequence
  Core polypeptide
TALLEQAQIQQEKNEYELQKLDK

SEQ ID NO: 1322 - protein, 23 aa, Artificial Sequence
  Core polypeptide
TALLEQAQIQQEKNEYELQKLDE

SEQ ID NO: 1323 - protein, 23 aa, Artificial Sequence
  Core polypeptide
TALLEQAQIQQEKNEYELQKLIE

SEQ ID NO: 1324 - protein, 23 aa, Artificial Sequence
  Core polypeptide
TALLEQAQIQQEKIEYELQKLDK

SEQ ID NO: 1325 - protein, 23 aa, Artificial Sequence
  Core polypeptide
TALLEQAQIQQEKIEYELQKLDE

SEQ ID NO: 1326 - protein, 23 aa, Artificial Sequence
  Core polypeptide
TALLEQAQIQQEKIEYELQKLIE

SEQ ID NO: 1327 - protein, 22 aa, Artificial Sequence
  Core polypeptide
TALLEQAQIQQEKIEYELQKLE

SEQ ID NO: 1328 - protein, 23 aa, Artificial Sequence
  Core polypeptide
TALLEQAQIQQEKIEYELQKLAK

SEQ ID NO: 1329 - protein, 23 aa, Artificial Sequence
  Core polypeptide
TALLEQAQIQQEKIEYELQKLAE

SEQ ID NO: 1330 - protein, 22 aa, Artificial Sequence
  Core polypeptide
TALLEQAQIQQEKAEYELQKLE

SEQ ID NO: 1331 - protein, 22 aa, Artificial Sequence
  Core polypeptide
TALLEQAQIQQEKNEYELQKLE

SEQ ID NO: 1332 - protein, 22 aa, Artificial Sequence
  Core polypeptide
TALLEQAQIQQEKGEYELQKLE

SEQ ID NO: 1333 - protein, 23 aa, Artificial Sequence
  Core polypeptide
TALLEQAQIQQEKAEYELQKLAK

SEQ ID NO: 1334 - protein, 23 aa, Artificial Sequence
  Core polypeptide
TALLEQAQIQQEKNEYELQKLAK

SEQ ID NO: 1335 - protein, 23 aa, Artificial Sequence
  Core polypeptide
TALLEQAQIQQEKGEYELQKLAK

SEQ ID NO: 1336 - protein, 23 aa, Artificial Sequence
  Core polypeptide
TALLEQAQIQQEKAEYELQKLAE

SEQ ID NO: 1337 - protein, 23 aa, Artificial Sequence
  Core polypeptide
TALLEQAQIQQEKNEYELQKLAE

SEQ ID NO: 1338 - protein, 23 aa, Artificial Sequence
  Core polypeptide
TALLEQAQIQQEKGEYELQKLAE

SEQ ID NO: 1339 - protein, 28 aa, Artificial Sequence
  Core polypeptide
DEFDASISQVNEKINQSLAFIRKSDELL

SEQ ID NO: 1340 - protein, 27 aa, Artificial Sequence
  Core polypeptide
DEYDASISQVNEKINQALAYIREADEL

SEQ ID NO: 1341 - protein, 27 aa, Artificial Sequence
  Core polypeptide
DEYDASISQVNEEINQALAYIRKADEL

SEQ ID NO: 1342 - protein, 28 aa, Artificial Sequence
  Core polypeptide
DEFDESISQVNEKIEESLAFIRKSDELL

SEQ ID NO: 1343 - protein, 27 aa, Artificial Sequence
  Core polypeptide
DEFDESISQVNEKIEESLAFIRKSDEL

SEQ ID NO: 1344 - protein, 10 aa, Artificial Sequence
  Core polypeptide
QHWSYGLRPG

SEQ ID NO: 1345 - protein, 35 aa, Artificial Sequence
  Core polypeptide
GLSPTVWLSVIWMMWYWGPSLYSILSPFLPLLPIF

SEQ ID NO: 1346 - protein, 36 aa, Artificial Sequence
  Core polypeptide
VGLSPTVWLSVIWMMWYWWGPSLYSILSPFLPLLPI

SEQ ID NO: 1347 - protein, 35 aa, Artificial Sequence
  Core polypeptide
FVGLSPTVWLSVIWMMWYWGPSLYSILSPFLPLLP

SEQ ID NO: 1348 - protein, 35 aa, Artificial Sequence
  Core polypeptide
WFVGLSPTVWLSVIWMMWYWGPSLYSILSPFLPLL

SEQ ID NO: 1349 - protein, 35 aa, Artificial Sequence
  Core polypeptide
QWFVGLSPTVWLSVIWMMWYWGPSLYSILSPFLPL

SEQ ID NO: 1350 - protein, 35 aa, Artificial Sequence
  Core polypeptide
VQWFVGLSPTVWLSVIWMMWYWGPSLYSILSPFLP

SEQ ID NO: 1351 - protein, 35 aa, Artificial Sequence
  Core polypeptide
FVQWFVGLSPTVWLSVIWMMWYWGPSLYSILSPFL

SEQ ID NO: 1352 - protein, 35 aa, Artificial Sequence
  Core polypeptide
PFVQWFVGLSPTVWLSVIWMMWYWGPSLYSILSPF

SEQ ID NO: 1353 - protein, 35 aa, Artificial Sequence
  Core polypeptide
VPFVQWFVGLSPTVWLSVIWMMWYWGPSLYSILSP

SEQ ID NO: 1354 - protein, 35 aa, Artificial Sequence
  Core polypeptide
LVPFVQWFVGLSPTVWLSVIWMMWYWGPSLYSILS

SEQ ID NO: 1355 - protein, 35 aa, Artificial Sequence
  Core polypeptide
LQAGFFLLTRILTIPQSLDSWWTSLNFLGGTTVAL

SEQ ID NO: 1356 - protein, 36 aa, Artificial Sequence
  Core polypeptide
WNWFIHSLIEESQNQQEKNEQELLELDKWASLWNWF

SEQ ID NO: 1357 - protein, 36 aa, Artificial Sequence
  Core polypeptide
YTNTIYTLLEESQNQQEKNEQELLELDKWASLWNWF

SEQ ID NO: 1358 - protein, 36 aa, Artificial Sequence
  Core polypeptide
YTGIIYNLLEESQNQQEKNEQELLELDKWANLWNWF

SEQ ID NO: 1359 - protein, 36 aa, Artificial Sequence; identical to SEQ ID NO: 1358
  Core polypeptide

SEQ ID NO: 1360 - protein, 36 aa, Artificial Sequence
  Core polypeptide
YTSLIYSLLEKSQIQQEKNEQELLELDKWASLWNWF

SEQ ID NO: 1361 - protein, 36 aa, Artificial Sequence
  Core polypeptide
YTSLIYSLLEKSQIQQEKNEQELLQLDKWASLWNWF

SEQ ID NO: 1362 - protein, 21 aa, Artificial Sequence
  Core polypeptide
EKSQIQQEKNEQELLELDKWA

SEQ ID NO: 1363 - skipped
  Core polypeptide

SEQ ID NO: 1364 - protein, 21 aa, Artificial Sequence
  Core polypeptide
EQAQIQQEKNEYELQKLDKWA

SEQ ID NO: 1365 - protein, 21 aa, Artificial Sequence
  Core polypeptide
EQAQIQQEKNEYELQKLDKWA

SEQ ID NO: 1366 - protein, 36 aa, Artificial Sequence
  Core polypeptide
  SITE (3)...(3): Xaa=any amino acid
  SITE (10)...(10): Xaa=any amino acid
  SITE (17)...(17): Xaa=any amino acid
  SITE (24)...(24): Xaa=any amino acid
YTXLIHSLIXESQNQQXKNEQELXELDKWASLWNWF

SEQ ID NO: 1367 - protein, 27 aa, Artificial Sequence
  Core polypeptide
  SITE (3)...(3): Xaa=any amino acid
  SITE (10)...(10): Xaa=any amino acid
  SITE (17)...(17): Xaa=any amino acid
  SITE (24)...(24): Xaa=any amino acid
YTXLIHSLIXESQNQQXKNEQELXELD

SEQ ID NO: 1368 - protein, 27 aa, Artificial Sequence
  Core polypeptide
YTSLIHSLIEESQNQQEKNEQELLELD

SEQ ID NO: 1369 - protein, 39 aa, Artificial Sequence
  Core polypeptide
  SITE (6)...(6): Xaa=any amino acid
  SITE (13)...(13): Xaa=any amino acid
  SITE (20)...(20): Xaa=any amino acid
  SITE (27)...(27): Xaa=any amino acid
WQEWEXKITALLXQAQIQQXKNEYELXKLDKWASLWEWF

SEQ ID NO: 1370 - protein, 34 aa, Artificial Sequence
  Core polypeptide
  SITE (1)...(1): Xaa=any amino acid
  SITE (8)...(8): Xaa=any amino acid
  SITE (15)...(15): Xaa=any amino acid
  SITE (22)...(22): Xaa=any amino acid
XKITALLXQAQIQQXKNEYELXKLDKWASLWEWF

SEQ ID NO: 1371 - protein, 30 aa, Artificial Sequence
  Core polypeptide
  SITE (6)...(6): Xaa=any amino acid
  SITE (13)...(13): Xaa=any amino acid
  SITE (20)...(20): Xaa=any amino acid
  SITE (27)...(27): Xaa=any amino acid
WQEWEXKITALLXQAQIQQXKNEYELXKLD

SEQ ID NO: 1372 - protein, 27 aa, Artificial Sequence
  Core polypeptide
WEQKITALLEQAQIQQEKNEYELQKLD

SEQ ID NO: 1373 - protein, 25 aa, Artificial Sequence
  Core polypeptide
  SITE (3)...(3): Xaa=any amino acid
  SITE (10)...(10): Xaa=any amino acid
  SITE (15)...(15): Xaa=any amino acid
  SITE (22)...(22): Xaa=any amino acid
WEXKITALLXQAQQXKNEYELXKLD

SEQ ID NO: 1374 - protein, 25 aa, Artificial Sequence
  Core polypeptide
  SITE (1)...(1): Xaa=any amino acid
  SITE (8)...(8): Xaa=any amino acid
  SITE (15)...(15): Xaa=any amino acid
  SITE (22)...(22): Xaa=any amino acid
XKITALLXQAQIQQXKNEYELXKLD

SEQ ID NO: 1375 - protein, 25 aa, Artificial Sequence
  Core polypeptide
QKITALLEQAQIQQEKNEYELQKLD

SEQ ID NO: 1376 - protein, 32 aa, Artificial Sequence
  Core polypeptide
VYPSDEYDASISQVNEEINQALAYIRKADELL

SEQ ID NO: 1377 - protein, 25 aa, Artificial Sequence
  Core polypeptide
QKITALLEQAQIQQEKNEYELQKLD

SEQ ID NO: 1378 - protein, 31 aa, Artificial Sequence
  Core polypeptide
VYPSDEYDASISQVNEEINQALAYIRKADEL

SEQ ID NO: 1379 - protein, 30 aa, Artificial Sequence
  Core polypeptide
WQEWEQKITALLEQAQIQQEKNEYELQKLD

SEQ ID NO: 1380 - protein, 34 aa, Artificial Sequence
  Core polypeptide
VYPSDEYDASISQVNEEINQALAYIRKADELLEN

SEQ ID NO: 1381 - protein, 34 aa, Artificial Sequence
  Core polypeptide
QKITALLEQAQIQQEKNEYELQKLDKWASLWEWF

SEQ ID NO: 1382 - protein, 35 aa, Artificial Sequence
  Core polypeptide
STNKAVVSLSNGVSVLTSKVLDLKNYIDKQLLPIV

SEQ ID NO: 1383 - protein, 35 aa, Artificial Sequence
  Core polypeptide
TNKAVVSLSNGVSVLTSKVLDLKNYIDKQLLPIVN

SEQ ID NO: 1384 - protein, 35 aa, Artificial Sequence
  Core polypeptide
NKAVVSLSNGVSVLTSKVLDLKNYIDKQLLPIVNK

SEQ ID NO: 1385 - protein, 35 aa, Artificial Sequence
  Core polypeptide
KAVVSLSNGVSVLTSKVLDLKNYIDKQLLPIVNKQ

SEQ ID NO: 1386 - protein, 36 aa, Artificial Sequence
  Core polypeptide
AVVSLSNGVSVLTSKVLDLLKNYIDKQLLPIVNKQS

SEQ ID NO: 1387 - protein, 34 aa, Artificial Sequence
  Core polypeptide
VVSLSNGVSVLTSKVLDLKNYIDKQLLPIVNKQS

SEQ ID NO: 1388 - protein, 34 aa, Artificial Sequence
  Core polypeptide
VSLSNGVSVLTSKVLDLKNYIDKQLLPIVNKQSS

SEQ ID NO: 1389 - protein, 34 aa, Artificial Sequence
  Core polypeptide
SLSNGVSVLTSKVLDLKNYIDKQLLPIVNKQSSI

SEQ ID NO: 1390 - protein, 34 aa, Artificial Sequence
  Core polypeptide
LSNGVSVLTSKVLDLKNYIDKQLLPIVNKQSSIS

SEQ ID NO: 1391 - protein, 34 aa, Artificial Sequence
  Core polypeptide
SNGVSVLTSKVLDLKNYIDKQLLPIVNKQSSISN

SEQ ID NO: 1392 - protein, 34 aa, Artificial Sequence
  Core polypeptide
NGVSVLTSKVLDLKNYIDKQLLPIVNKQSSISNI

SEQ ID NO: 1393 - protein, 34 aa, Artificial Sequence
  Core polypeptide
GVSVLTSKVLDLKNYIDKQLLPIVNKQSSISNIE

SEQ ID NO: 1394 - protein, 34 aa, Artificial Sequence
  Core polypeptide
VSVLTSKVLDLKNYIDKQLLPIVNKQSSISNIET

SEQ ID NO: 1395 - protein, 34 aa, Artificial Sequence
  Core polypeptide
SVLTSKVLDLKNYIDKQLLPIVNKQSSISNIETV

SEQ ID NO: 1396 - protein, 34 aa, Artificial Sequence
  Core polypeptide
VLTSKVLDLKNYIDKQLLPIVNKQSSISNIETVI

SEQ ID NO: 1397 - protein, 33 aa, Artificial Sequence
  Core polypeptide
LTSKVLDKNYIDKQLLPIVNKQSSISNIETVIE

SEQ ID NO: 1398 - protein, 34 aa, Artificial Sequence
  Core polypeptide
TSKVLDLKNYIDKQLLPIVNKQSSISNIETVIEF

SEQ ID NO: 1399 - protein, 34 aa, Artificial Sequence
  Core polypeptide
SKVLDLKNYIDKQLLPIVNKQSSISNIETVIEFQ

SEQ ID NO: 1400 - protein, 34 aa, Artificial Sequence
  Core polypeptide
KVLDLKNYIDKQLLPIVNKQSSISNIETVIEFQQ

SEQ ID NO: 1401 - protein, 34 aa, Artificial Sequence
  Core polypeptide
VLDLKNYIDKQLLPIVNKQSSISNIETVIEFQQK

SEQ ID NO: 1402 - protein, 34 aa, Artificial Sequence
  Core polypeptide
LDLKNYIDKQLLPIVNKQSSISNIETVIEFQQKN

SEQ ID NO: 1403 - protein, 34 aa, Artificial Sequence
  Core polypeptide
DLKNYIDKQLLPIVNKQSSISNIETVIEFQQKNN

SEQ ID NO: 1404 - protein, 34 aa, Artificial Sequence
  Core polypeptide
LKNYIDKQLLPIVNKQSSISNIETVIEFQQKNNR

SEQ ID NO: 1405 - protein, 34 aa, Artificial Sequence
  Core polypeptide
KNYIDKQLLPIVNKQSSISNIETVIEFQQKNNRL

SEQ ID NO: 1406 - protein, 35 aa, Artificial Sequence
  Core polypeptide
NYIDKQLLPIVNKQSISISNIETVIEFQQKNNRLL

SEQ ID NO: 1407 - protein, 34 aa, Artificial Sequence
  Core polypeptide
YIDKQLLPIVNKQSSISNIETVIEFQQKNNRLLE

SEQ ID NO: 1408 - protein, 34 aa, Artificial Sequence
  Core polypeptide
IDKQLLPIVNKQSSISNIETVIEFQQKNNRLLEI

SEQ ID NO: 1409 - protein, 34 aa, Artificial Sequence
  Core polypeptide
DKQLLPIVNKQSSISNIETVIEFQQKNNRLLEIT

SEQ ID NO: 1410 - protein, 34 aa, Artificial Sequence
  Core polypeptide
KQLLPIVNKQSSISNIETVIEFQQKNNRLLEITR

SEQ ID NO: 1411 - protein, 34 aa, Artificial Sequence
  Core polypeptide
QLLPIVNKQSSISNIETVIEFQQKNNRLLEITRE

SEQ ID NO: 1412 - protein, 23 aa, Artificial Sequence
  Core polypeptide
VYPSDEYDASISQVNEEINQALA

SEQ ID NO: 1413 - protein, 23 aa, Artificial Sequence
  Core polypeptide
QVNEEINQALAYIRKADELLENV

SEQ ID NO: 1414 - protein, 35 aa, Artificial Sequence; identical to SEQ ID NO: 692
  Core polypeptide

SEQ ID NO: 1415 - protein, 27 aa, Artificial Sequence
  Core polypeptide
DEYDASISQVNEEINQALAYIREADEL

SEQ ID NO: 1416 - protein, 27 aa, Artificial Sequence
  Core polypeptide
DEYDASISQVNEKINQALAYIREADEL

SEQ ID NO: 1417 - protein, 35 aa, Artificial Sequence; identical to SEQ ID NO: 1240
  Core polypeptide

SEQ ID NO: 1418 - protein, 34 aa, Artificial Sequence
  Core polypeptide
DDELNSVKNGTYDFPKFEEESKLNRNEIKGVKLS

SEQ ID NO: 1419 - protein, 39 aa, Artificial Sequence
  Core polypeptide
YHKCDDECLNSVKNGTFDFPKFEEESKLNREIKGVKLSS

SEQ ID NO: 1420 - protein, 38 aa, Artificial Sequence
  Core polypeptide
YHKDDELNSVKNGTFDFPKFEEESKLNRNEIKGVKLSS

SEQ ID NO: 1421 - protein, 36 aa, Artificial Sequence; identical to SEQ ID NO: 1246
  Core polypeptide

SEQ ID NO: 1422 - protein, 36 aa, Artificial Sequence; identical to SEQ ID NO: 1247
  Core polypeptide

SEQ ID NO: 1423 - protein, 36 aa, Artificial Sequence; identical to SEQ ID NO: 1248
  Core polypeptide

SEQ ID NO: 1424 - protein, 36 aa, Artificial Sequence; identical to SEQ ID NO: 1249
  Core polypeptide

SEQ ID NO: 1425 - protein, 36 aa, Artificial Sequence; identical to SEQ ID NO: 1250
  Core polypeptide

SEQ ID NO: 1426 - protein, 36 aa, Artificial Sequence; identical to SEQ ID NO: 1251
  Core polypeptide

SEQ ID NO: 1427 - protein, 35 aa, Artificial Sequence
  Core polypeptide
YTSLIHSLIEESQIQQEKNEYELQKLDWASLWEWF

SEQ ID NO: 1428 - protein, 36 aa, Artificial Sequence; identical to SEQ ID NO: 1253
  Core polypeptide

SEQ ID NO: 1429 - protein, 36 aa, Artificial Sequence; identical to SEQ ID NO: 1254
  Core polypeptide

SEQ ID NO: 1430 - protein, 36 aa, Artificial Sequence; identical to SEQ ID NO: 1255
  Core polypeptide

SEQ ID NO: 1431 - protein, 35 aa, Artificial Sequence
  Core polypeptide
WQEWEQKITALLEQAQIQQEKNEYELQKLDKWEWF

SEQ ID NO: 1432 - protein, 39 aa, Artificial Sequence
  Core polypeptide
WQEWEQKITALLEQAQIQQEKNEYELQKLIEWASLWEWF

SEQ ID NO: 1433 - protein, 8 aa, Artificial Sequence
  Core polypeptide
WASLWEWF

SEQ ID NO: 1434 - protein, 35 aa, Artificial Sequence; identical to SEQ ID NO: 1122
  Core polypeptide

SEQ ID NO: 1435 - protein, 35 aa, Artificial Sequence; identical to SEQ ID NO: 1123
  Core polypeptide

SEQ ID NO: 1436 - protein, 31 aa, Artificial Sequence
  Core polypeptide
WQAWDEYDASISDVNEKINQALAYIREADEL

SEQ ID NO: 1437 - protein, 8 aa, SIV and HIV-2
WLEWERQI

SEQ ID NO: 1438 - protein, 8 aa, SIV and HIV-2
WLEWEKQI

SEQ ID NO: 1439 - protein, 8 aa, SIV and HIV-2
WQQWEQQI

SEQ ID NO: 1440 - protein, 8 aa, SIV and HIV-2
WQQWEKQI

SEQ ID NO: 1441 - protein, 8 aa, SIV and HIV-2
WQEWEHKI

SEQ ID NO: 1442 - protein, 8 aa, SIV and HIV-2
WQEWEGKI

SEQ ID NO: 1443 - protein, 8 aa, SIV and HIV-2
WQEWEQQI

SEQ ID NO: 1444 - protein, 8 aa, SIV and HIV-2
WQKWEQQI

SEQ ID NO: 1445 - protein, 8 aa, SIV and HIV-2
WQEWEQRI

SEQ ID NO: 1446 - protein, 8 aa, HIV-1
WLQWDKEI

SEQ ID NO: 1447 - protein, 8 aa, HIV-1
WMDWEREI

SEQ ID NO: 1448 - protein, 8 aa, HIV-1
WMEWEKEI

SEQ ID NO: 1449 - protein, 8 aa, HIV-1
WMEWDREI

SEQ ID NO: 1450 - protein, 8 aa, HIV-1
WMEWEREI

SEQ ID NO: 1451 - protein, 8 aa, HIV-1
WIEWEREI

SEQ ID NO: 1452 - protein, 8 aa, HIV-1
WIEWDREI

SEQ ID NO: 1453 - protein, 8 aa, HIV-1
WMQWDREI

SEQ ID NO: 1454 - protein, 8 aa, HIV-1
WIQWEREI

SEQ ID NO: 1455 - protein, 8 aa, HIV-1
WGIWRWGI

SEQ ID NO: 1456 - protein, 8 aa, HIV-1
WIQWDREI

SEQ ID NO: 1457 - protein, 8 aa, HIV-1
WIQWEKEI

SEQ ID NO: 1458 - protein, 8 aa, HIV-1
WMQWEKEI

SEQ ID NO: 1459 - protein, 8 aa, HIV-1
WQQWDQHI

SEQ ID NO: 1460 - protein, 8 aa, HIV-1
WMQWEREI

SEQ ID NO: 1461 - protein, 8 aa, HIV-1
WQEWDRQI

SEQ ID NO: 1462 - protein, 8 aa, HIV-1
WQQWDQQI

SEQ ID NO: 1463 - protein, 8 aa, HIV-1
WIEWKREI

SEQ ID NO: 1464 - protein, 8 aa, HIV-1
WMEWEMEI

SEQ ID NO: 1465 - protein, 8 aa, HIV-1
WIEWEKEI

SEQ ID NO: 1466 - protein, 8 aa, HIV-1
WMQWKREI

SEQ ID NO: 1467 - protein, 8 aa, HIV-1
WMEWNREI

SEQ ID NO: 1468 - protein, 8 aa, HIV-1
WREWDREI

SEQ ID NO: 1469 - protein, 8 aa, HIV-1
WTEWEREI

SEQ ID NO: 1470 - protein, 8 aa, HIV-1
WLEWEREI

SEQ ID NO: 1471 - protein, 8 aa, HIV-1
WMGWEREI

SEQ ID NO: 1472 - protein, 8 aa, HIV-1
WQEWDQQI

SEQ ID NO: 1473 - protein, 8 aa, HIV-1
WMKWEREI

SEQ ID NO: 1474 - protein, 8 aa, SIV
WAGLWEWF

SEQ ID NO: 1475 - protein, 8 aa, SIV
WSNFWSWF

SEQ ID NO: 1476 - protein, 8 aa, SIV
WDSLWSWF

SEQ ID NO: 1477 - protein, 8 aa, SIV
WSGFWSWF

SEQ ID NO: 1478 - protein, 8 aa, SIV
WSSLWNWF

SEQ ID NO: 1479 - protein, 8 aa, SIV
WSDFWSWF

SEQ ID NO: 1480 - protein, 8 aa, SIV
WSDIWSWV

SEQ ID NO: 1481 - protein, 8 aa, SIV
WASLWNWF

SEQ ID NO: 1482 - protein, 8 aa, SIV
WSSFWSWF

SEQ ID NO: 1483 - protein, 8 aa, HIV-2
WDVFGNWF

SEQ ID NO: 1484 - protein, 8 aa, HIV-2
WDVFTNWL

SEQ ID NO: 1485 - protein, 8 aa, HIV-2
WDIFGNWF

SEQ ID NO: 1486 - protein, 8 aa, HIV-2
WDVFGNWL

SEQ ID NO: 1487 - protein, 8 aa, HIV-2
WDIFGNWS

SEQ ID NO: 1488 - protein, 8 aa, HIV-2
WDVFSNWF

SEQ ID NO: 1489 - protein, 8 aa, HIV-2
WDILGNWF

SEQ ID NO: 1490 - protein, 8 aa, HIV-1
WANLWNWF

SEQ ID NO: 1491 - protein, 8 aa, HIV-1
WASLWNWF

SEQ ID NO: 1492 - protein, 8 aa, HIV-1
WENLWNWF

SEQ ID NO: 1493 - protein, 8 aa, HIV-1
WASLWNWV

SEQ ID NO: 1494 - protein, 8 aa, HIV-1
WENLWSWF

SEQ ID NO: 1495 - protein, 8 aa, HIV-1
WDSLWGWF

SEQ ID NO: 1496 - protein, 8 aa, HIV-1
WDSLWNWF

SEQ ID NO: 1497 - protein, 8 aa, HIV-1
WASLWTWF

SEQ ID NO: 1498 - protein, 8 aa, HIV-1
WKNLWNWF

SEQ ID NO: 1499 - protein, 8 aa, HIV-1
WTSLWSWF

SEQ ID NO: 1500 - protein, 8 aa, HIV-1
WASIWNWL

SEQ ID NO: 1501 - protein, 8 aa, HIV-1
WQNLWNWF

SEQ ID NO: 1502 - protein, 8 aa, HIV-1
WQNLWSWF

SEQ ID NO: 1503 - protein, 8 aa, HIV-1
WPNLWNWF

SEQ ID NO: 1504 - protein, 8 aa, HIV-1
WASLWSWF

SEQ ID NO: 1505 - protein, 8 aa, HIV-1
WSSLWNWF

SEQ ID NO: 1506 - protein, 8 aa, HIV-1
WGSLWSWF

SEQ ID NO: 1507 - protein, 8 aa, HIV-1
WANLWSWF

SEQ ID NO: 1508 - protein, 8 aa, HIV-1
WAGLWNWF

SEQ ID NO: 1509 - protein, 8 aa, HIV-1
WTNLWNWF

SEQ ID NO: 1510 - protein, 8 aa, HIV-1
WPSLWNWF

SEQ ID NO: 1511 - protein, 8 aa, HIV-1
WAGLWSWF

SEQ ID NO: 1512 - protein, 8 aa, HIV-1
WASLWTWS

SEQ ID NO: 1513 - protein, 50 aa, HIV-1
NNMTWMEWDREINNYTSLIHSLIEESQNQQEKNEQELLELDKWASLWNWF

SEQ ID NO: 1514 - protein, 36 aa, HIV-1; identical to SEQ ID NO: 621

SEQ ID NO: 1515 - protein, 30 aa, HIV-1; identical to SEQ ID NO: 1285

What is claimed is:

1. A pharmaceutical composition comprising an effective amount of (a) a hybrid polypeptide comprising an enhancer peptide linked to a core polypeptide, wherein the enhancer peptide comprises an amino-terminal: WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW, and wherein the core polypeptide comprises TALLEQAQIQQEKNEYELQKLDK (SEQ.ID NO:1286); and (b) another therapeutic agent.

2. The pharmaceutical composition of claim 1, wherein the hybrid polypeptide further comprises a carboxy-terminal enhancer peptide.

3. A pharmaceutical composition comprising an effective amount of a) a hybrid polypeptide comprising an enhancer peptide linked to a core polypeptide, wherein the enhancer peptide comprises a carboxy-terminal: WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW,or XWXXXW, and wherein the core polypeptide comprises TALLEQAQIQQEKNEYELQKLDK (SEQ ID NO:1286); and (b) another therapeutic agent.

4. The pharmaceutical composition of claim 1, wherein the hybrid polypeptide further comprises an amino-terminal enhancer peptide.

5. A pharmaceutical composition comprising an effective amount of (a) a hybrid polypeptide comprising an enhancer peptide sequence linked to a core polypeptide, wherein the enhancer peptide sequence comprises WQEWEQKI (SEQ ID NO: 1129) or WASLWEWF (SEQ ID NO: 1433) and the core polypeptide comprises TALLEQAQIQQEKNEYELQKLDK (SEQ ID NO: 1286); and (b) another therapeutic agent.

6. A pharmaceutical composition comprising an effective amount of a polypeptide comprising WQEWEQKI-TALLEQAQIQQEKNEYELQKLDKWASLWEWF (SEQ ID NO: 1310); and another therapeutic agent.

7. A pharmaceutical composition comprising an effective amount of a polypeptide comprising TALLEQAQIQQEKNEYELQKLDK (SEQ ID NO: 1286); and another therapeutic agent.

8. The pharmaceutical composition of any of claims 1–7, wherein the polypeptide further comprises an amino terminal acetyl group and a carboxy terminal amido group.

9. The pharmaceutical composition of any of claims 1–7, further comprising a pharmaceutically acceptable carrier.

10. The pharmaceutical composition of any of claims 1–7, wherein the other therapeutic agent is an antiviral agent.

11. The pharmaceutical composition of claim 10, wherein the antiviral agent is DP-107, DP-178, a cytokine, a reverse transcriptase inhibitor, a viral mRNA capping inhibitor, a viral protease inhibitor, a lipid-binding molecule with anti-HIV activity, or an inhibitor of glycoprotein processing.

12. A method for inhibiting HIV infection comprising administering to a patient in need thereof an effective amount of a hybrid polypeptide comprising an enhancer peptide linked to a core polypeptide, wherein the enhancer peptide comprises an amino-terminal: WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW, and wherein the core polypeptide comprises TALLEQAQIQQEKNEYELQKLDK(SEQ ID NO: 1286).

13. The method of claim 12, wherein the hybrid polypeptide further comprises a carboxy-terminal enhancer peptide.

14. A method for inhibiting HIV infection comprising administering to a patient in need thereof an effective amount of a hybrid polypeptide comprising an enhancer peptide linked to a core polypeptide, wherein the enhancer peptide comprises a carboxy-terminal: WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW, and wherein the core polypeptide comprises TALLEQAQIQQEKNEYELQKLDK (SEQ ID NO:1286).

15. The method of claim 14, wherein the hybrid polypeptide further comprises an amino-terminal enhancer peptide.

16. A method for inhibiting HIV infection comprising administering to a patient in need thereof an effective amount of a hybrid polypeptide comprising an enhancer peptide sequence linked to a core polypeptide, wherein the enhancer peptide sequence comprises WQEWEQKI (SEQ ID NO:1129) or WASLWEWF (SEQ ID NO:1433) and the core polypeptide comprises TALLEQAQIQQEKNEYELQKLDK (SEQ ID NO: 1286).

17. A method for inhibiting HIV infection comprising administering to a patient in need thereof an effective amount of a polypeptide comprising WQEWEQKI-TALLEQAQIQQEKNEYELQKLDKWASLWEWF (SEQ ID NO: 1310).

18. A method for inhibiting HIV infection comprising administering to a patient in need thereof an effective amount of a polypeptide comprising TALLEQAQIQQEKNEYELQKLDK (SEQ ID NO:1286).

19. The method of any of claims 12–18, wherein the polypeptide further comprises an amino terminal acetyl group and a carboxy terminal amido group.

20. The method of claim 19 further comprising administering a pharmaceutically acceptable carrier.

21. The method of any of claims 12–18 further comprising administering a pharmaceutically acceptable carrier.

22. The method of claim 21, wherein the administering is performed via oral, rectal, vaginal, lung, transdermal, transmucosal, intestinal, parenteral, intramuscular, subcutaneous, intramedullary, intrathecal, intraventricular, intravenous, intraperitoneal, intranasal or intraocular route.

23. The method of claim 21 further comprising administering an effective amount of at least one other therapeutic agent.

24. The method of claim 23, wherein the other therapeutic agent is an antiviral agent.

25. The method of claim 24, wherein the antiviral agent is DP-107, DP-178, a cytokine, a reverse transcriptase inhibitor, a viral mRNA capping inhibitor, a viral protease inhibitor, a lipid-binding molecule with anti-HIV activity, or an inhibitor of glycoprotein processing.

26. The method of claim 25, wherein the administering is performed concomitantly, sequentially, with interruption or by cycling therapy.

27. The method of claim 20 or claim 23, wherein the administering is performed via oral, rectal, vaginal, lung, transdermal, transmucosal, intestinal, parenteral, intramuscular, subcutaneous, intramedullary, intrathecal, intraventricular, intravenous, intraperitoneal, intranasal or intraocular route.

28. The composition of claim 11 wherein the antiviral agent is DP-107.

29. The composition of claim 11 wherein the antiviral agent is DP-178.

30. The composition of claim 11 wherein the antiviral agent is a cytokine.

31. The composition of claim 11 wherein the antiviral agent is a reverse transcriptase inhibitor.

32. The composition of claim 11 wherein the antiviral agent is a viral mRNA capping inhibitor.

33. The composition of claim 11 wherein the antiviral agent is a viral protease inhibitor.

34. The composition of claim 11 wherein the antiviral agent is a lipid-binding molecule with anti-HIV activity.

35. The composition of claim 11 wherein the antiviral agent is an inhibitor of glycoprotein processing.

36. The method of claim 22 wherein the administering is performed via subcutaneous route.

37. The method of claim 22 wherein the administering is performed via intravenous route.

38. The method of claim 25 wherein the antiviral agent is DP-107.

39. The method of claim 25 wherein the antiviral agent is DP-178.

40. The method of claim 25 wherein the antiviral agent is a cytokine.

41. The method of claim 25 wherein the antiviral agent is a reverse transcriptase inhibitor.

42. The method of claim 25 wherein the antiviral agent is a viral mRNA capping inhibitor.

43. The method of claim 25 wherein the antiviral agent is a lipid-binding molecule with anti-HIV activity.

44. The method of claim 25 wherein the antiviral agent is an inhibitor of glycoprotein processing.

45. The method of claim 27 wherein the administering is performed via subcutaneous route.

46. The method of claim 27 wherein the administering is performed via intravenous route.

47. The method of claim 12 wherein the enhancer peptide comprises an amino-terminal: WXXWXXXI.

48. The method of claim 12 wherein the enhancer peptide comprises an amino-terminal: WXXXWXWX.

49. The method of claim 12 wherein the enhancer peptide comprises an amino-terminal: IXXXWXXW.

50. The method of claim 12 wherein the enhancer peptide comprises an amino-terminal: XWXWXXXW.

51. The method of claim 14 wherein the enhancer peptide comprises a carboxy-terminal: WXXWXXXI.

52. The method of claim 14 wherein the enhancer peptide comprises a carboxy-terminal: WXXXWXWX.

53. The method of claim 14 wherein the enhancer peptide comprises a carboxy-terminal: IXXXWXXW.

54. The method of claim 14 wherein the enhancer peptide comprises a carboxy-terminal: XWXWXXXW.

\* \* \* \* \*